US009783579B2

(12) United States Patent
Stinchcomb et al.

(10) Patent No.: US 9,783,579 B2
(45) Date of Patent: Oct. 10, 2017

(54) COMPOSITIONS AND METHODS FOR DENGUE VIRUS CHIMERIC CONSTRUCTS IN VACCINES

(71) Applicants: Dan T. Stinchcomb, Fort Collins, CO (US); Claire Kinney, Fort Collins, CO (US); Richard M Kinney, Fort Collins, CO (US); Jill A Livengood, Fort Collins, CO (US)

(72) Inventors: Dan T. Stinchcomb, Fort Collins, CO (US); Claire Kinney, Fort Collins, CO (US); Richard M Kinney, Fort Collins, CO (US); Jill A Livengood, Fort Collins, CO (US)

(73) Assignees: Takeda Vaccines, Inc., Deerfield, IL (US); The United States of America as Represented by the Secretary of the Department of Health and Human Services, Washington, DC (US)

( * ) Notice: Subject to any disclaimer, the term of this patent is extended or adjusted under 35 U.S.C. 154(b) by 49 days.

(21) Appl. No.: 14/209,808

(22) Filed: Mar. 13, 2014

(65) Prior Publication Data

US 2014/0302088 A1   Oct. 9, 2014

Related U.S. Application Data

(60) Provisional application No. 61/800,204, filed on Mar. 15, 2013.

(51) Int. Cl.
| | |
|---|---|
| A61K 39/12 | (2006.01) |
| C07K 14/005 | (2006.01) |
| A61K 31/713 | (2006.01) |
| A61K 31/7048 | (2006.01) |
| A61K 39/00 | (2006.01) |

(52) U.S. Cl.
CPC ........ *C07K 14/005* (2013.01); *A61K 31/7048* (2013.01); *A61K 31/713* (2013.01); *A61K 39/12* (2013.01); *A61K 2039/5254* (2013.01); *A61K 2039/70* (2013.01); *C12N 2770/24122* (2013.01); *C12N 2770/24134* (2013.01); *C12N 2770/24141* (2013.01); *C12N 2770/24143* (2013.01); *C12N 2770/24162* (2013.01)

(58) Field of Classification Search
None
See application file for complete search history.

(56) References Cited

U.S. PATENT DOCUMENTS

| | | | |
|---|---|---|---|
| 4,810,492 A | 3/1989 | Fujita et al. | |
| 5,021,347 A | 6/1991 | Yasui et al. | |
| 5,229,293 A | 7/1993 | Matsuura et al. | |
| 5,494,671 A | 2/1996 | Lai et al. | |
| 5,514,375 A | 5/1996 | Paoletti et al. | |
| 6,165,477 A | 12/2000 | Ivy et al. | |
| 6,184,024 B1 | 2/2001 | Lai et al. | |
| 6,660,273 B2 | 12/2003 | Pletnev et al. | |
| 7,094,411 B2 | 8/2006 | Kinney et al. | |
| 8,673,316 B2 | 3/2014 | Kinney et al. | |

FOREIGN PATENT DOCUMENTS

| | | |
|---|---|---|
| JP | 5276941 A | 10/1993 |
| WO | 9001946 A1 | 3/1990 |
| WO | 9203545 A1 | 3/1992 |
| WO | 9306214 A1 | 1/1993 |
| WO | 9640933 A1 | 12/1996 |
| WO | 9837911 A1 | 9/1998 |
| WO | 9963095 A1 | 12/1999 |
| WO | 0160847 A2 | 8/2001 |
| WO | 0272036 A1 | 9/2002 |
| WO | 2014074912 A1 | 5/2014 |

OTHER PUBLICATIONS

Butrapet S et al: "Attenuation markers of a candidate dengue type 2 vaccine virus. strain 16681 (PDK-53). are defined by mutations in the 5• noncoding region and nonstructural proteins 1 and 3".Journal of Virology. The American Society for Microbiology. US, vol. 74. No. 7. Apr. 1, 2000 (Apr. 1, 2000). pp. 3011-3019. XP002174038. ISSN: 0022-538X. DOI: 10.1128/JVI.74.7.3011-3019.2000.
Claire Y.-H. Huang et al: Genetic and Phenotypic Characterization of Manufacturing Seeds for a Tetravalent Dengue Vaccine (DENVax) PLOS Neglected Tropical Diseases, vol. 7, No. 5, 38 May 2813 (2813-05-38) ISSN: 1935-2727, DOI: 10.1371 journal. pntd. 8082243.
Hsiang-Chi Lee et al: 11 Dengue Type 4 Live-Attenuated Vaccine Viruses Passaged in Vera Cells Affect Genetic Stability and Dengue-Induced Hemorrhaging in Mice.. , PLOS ONE, vol. 6, No. 10, Oct. 28, 2011 (Oct. 28, 2011), p. e25800, XP055148033, DOI: 10.1371fjournal.pone.0025800.
Huang C Y-H et al: "Chimeric dengue type 2 (vaccine strain PDK-53)/dengue type 1 virus as a potential candidate dengue type 1 virus vaccine". Journal of Virology. The American Society for Microbiology. US. vol. 74. No. 7. Apr. 1, 2000 (Apr. 1, 2000). pp. 3020-3028. XP002174039.ISSN: 0022-538X. DOI:10.1128/JV1. 74.7.3020-3028.2000.
Huang C Y-H et al: "Dengue 2 PDK-53 virus as a chimeric carrier for tetravalent dengue vaccine development" Journal of Virology. The American Society for Microbiology. US. vol. 77. No. 21. Nov. 1, 2003 (Nov. 1, 2003). pp. 11436-11447. XP003005064. ISSN: 0022-538X. DOI: 10.1128/JVI.77.21.11436-11447.2003 p. 11436—col. 2; table 1.
International Search Report and Written Opinion issued in PCT/US2014/024603, mailed Nov. 5, 2014, 26 pages.

(Continued)

*Primary Examiner* — Stacy B Chen

(74) *Attorney, Agent, or Firm* — Faegre Baker Daniels LLP

(57) ABSTRACT

Embodiments herein report compositions, uses and manufacturing of dengue virus constructs and live attenuated dengue viruses. Some embodiments concern a composition that includes, but is not limited to, a tetravalent dengue virus composition. In certain embodiments, compositions can include constructs of one or more serotypes of dengue virus, such as dengue-1 (DEN-1) virus, dengue-2 (DEN-2) virus, dengue-3 (DEN-3) or dengue-4 (DEN-4) virus constructs. In other embodiments, constructs disclosed herein can be combined in a composition to generate a vaccine against more (Continued)

one or more dengue virus constructs that may or may not be subsequently passaged in mammalian cells.

11 Claims, 10 Drawing Sheets

(56) References Cited

OTHER PUBLICATIONS

Jorge E Osorio et al: "Development of DENVax: A chimeric dengue-2 PDK-53-based tetravalent vaccine for protection against

(56) References Cited

OTHER PUBLICATIONS dengue fever". Vaccine. vol. 29. No. 42. Jul. 21, 2011 (Jul. 21, 2011)• pp. 7251-7260. XP028285284. ISSN: 0264-410X. DOI:10.1016/J.Vaccine.2011.07.020.
Phillpotts et al., "Immunization with DNA polynucleotides protects mice against lethal challenge with St. Louis encephalitis virus." Arch. Virol. 141:743-749 (1996).
Pletnev, A. G. et al., "Chimeric Tick-Borne Encephalitis and Dengue Type 4 Viruses: Effects of Mutations on Neurovirulence in Mice." J. Virol. 67(8):4956-4963 (Aug. 1993).
Pletnev et al., "Construction and characterization of chimeric tick-borne encephalitis/ dengue type 4 viruses." Proc. Nat. Acad. Sci. USA 89:10532-10536 (Nov. 1992).
Puri et al., "Molecular analysis of dengue virus attenuation after serial passage in primary dog kidney cells." J. Gen. Virol 78:2287-2291 (1997).
Rice et al., "Nucleotide Sequence of Yellow Fever Virus: Implications for Flavivirus Gene Expression and Evolution." Science 229:726-733 (1985).
Rice et al., "Transcription of Infectious Yellow Fever RNA from Full-Length cDNA Templates Produced by in Vitro Ligation." New Biologist 1(3):285-296 (Dec. 1989).
Roehrig et al., "Identification of Epitopes on the E Glycoprotein of Saint Louis Encephalitis Virus Using Monoclonal Antibodies." Virology 128: 118-126 (1983).
Roehrig et al., "Synthetic Peptides Derived from the Deduced Amino Acid Sequence of the E-Glycoprotein of Murray Valley Encephalitis Virus Elicit Antiviral Antibody." Virology 171:49-60 (1989).
Sato et al., "Immunostimulatory DNA Sequences Necessary for Effective Intradermal Gene Immunization." Science 273(5273):352-354 (Jul. 19, 1996).
Seeger et al., "The cloned genome of ground squirrel hepatitis virus is infectious in the animal." Proc. Nat/. Acad. Sci. USA 81:5849-5852 (Sep. 1984).
Sela. The Choice of Carrier. In Synthetic Vaccines vol. I, R. Amon, (ed) CRC Press Inc., Boca Raton, FL. Chapter 6 pp. 83-92 (1987).
Smithburn et al., "A Neurotropic Virus Isolated From the Blood of a Native of Uganda." Am. J. Trop. Med. Hyg. 20:471-492 (1940).
Stocks et al: "Signal peptidase cleavage at the flavivirus C-prM junction: dependence on the viral NS2B-3 protease for efficient processing requires determinants in C, the signal peptide, and prM.", Journal of Virology Mar. 1998 LNKDPUBMED: 9499070, vol. 72, No. 3, Mar. 1998 (Mar. 1998), pp. 2141-2149.
Subchareon et al., "Safety and Immunogenictiy of Tetra Live-Attenuated Dengue Vaccines in Thai Adult Volunteers: Role of Serotype Concentration, Ratio, and Multiple Doses." Am. J. Trop. Med. Hyg. 66(3):264-272 (2002).
Sumiyoshi et al., "Complete Nucleotide Sequence of the Japanese Encephalitis Virus Genome RNA." Virology 161:497-510 (1987).
Tardei et al., "Evaluation of Immunoglobulin M (IgM) and IgG Enzyme Immunoassays in Serologic Diagnosis of West Nile Virus Infection." J. Clin. Microbial. 38(6):2232-2239 (Jun. 2000).
Trent et al., "Partial Nucleotide Sequence of St. Louis Encephalitis Virus RNA: Structural Proteins, NS1, ns2a, and ns2b." Virology 156:293-304 (1987).
Trent et al., "Recombinant dengue virus vaccines." In: Dengue and Dengue Hemorrhagic Fever. D.J. Gubler and G. Kuno (eds.). CAB International, New York, NY Chapter 18 pp. 379-403. (1997).
Troyer et al., "A Live Attenuated Recombinant Dengue-4 Virus Vaccine Candidate With Restricted capacity for Dissemination in Mosquitoes and Lack of Transmission From Vaccines to Mosquitoes." Am. J. Trop. Med. Hyg. 65 (5):414-419 (2001).
Tsai et al., Japanese Encephalitis Vaccines. In Vaccines, (2nd edition), Plotkin and Mortimer (eds.), W.B. Saunders Co., Philadelphia, PA. Chapter 24, pp. 671-713 (1994).
Tsai et al. Japanese Encephalitis Vaccines. In Vaccines, (3rd edition) Plotkin and Orenstein (eds), W.B. Saunders Company, Philadelphia, PA. Chapter 27, pp. 672-710 (1999).

Update: "Surveillance for West Nile Virus in Overwintering Mosquitoes—New York, 2000." Morb. Mortal. Wkly. Rep. 49(09): 178-179 (Mar. 10, 2000).
Update, "West Nile Virus Activity—Northeastern United States, 2000." Morb. Mortal. Wkly. Rep. 49(36):820-822 (Sep. 15, 2000).
Van Der Most et al., "Chimeric yellow fever/dengue virus as a candidate dengue vaccine: quantification of the dengue virus-specific CD8 T-cell response". Journal of Virology. The American Society for Microbiology. US. vol. 74. No. 17. Sep. 1, 2000 (Sep. 1, 2000). pp. 8094-8101.
Vaughn et al., "Testing of dengue 2 live-attenuated vaccine (strain 16681 PDK 53) in ten American volunteers." Vaccine 14(4):329-336 (1996).
Venugopal et al., "Immunity to St. Louis encephalitis virus by sequential immunization with recombinant vaccinia and baculovirus derived PrM/E proteins." Vaccine 13(11 ): 1000-1005 (1995).
Wang et al., "Immune Response to Neonatal Genetic Immunization." Virology 228:278-284 (1997).
Wolff et al., "Long-term persistence of plasmid DNA and foreign gene expression in mouse muscle." Hum. Mol. Genet. 1(6):363-369 (1992).
Yamshchikov et al., "Processing of the intracellular form of the west Nile virus capsid protein by the viral NS2B-NS3 protease: an in vitro study.", Journal of Virology Sep. 1994 LNKDPUBMED: 8057458, vol. 68. No. 9, Sep. 1994 (Sep. 1994), pp. 5765-5771.
Yang et al., "A p300/CBP-associated factor that competes with the adenoviral oncoprotein E1A." Nature 382:319-324 (Jul. 25, 1996).
Yoksan et al., "Dengue virus vaccine developmfsent: study on biological markers of uncloned dengue 1-4 viruses serially passaged in primary kidney cell", In Arbovirus Research in Australia, Proceedings of the Fourth Symposium. T. D. St. George, B. H. Kay, and J. Blok (eds.), CSIRO/QIMR, Brisbane p. 35-38 (1986).
Zhao et al., "Cloning Full-Length Dengue Type 4 Viral DNA Sequences: Analysis of Genes Coding for Structural Proteins." Virology 155:77-88 (1986).
Zhao et al., "Expression of Dengue Virus Structural Proteins and Nonstructural Protein NS1 by a Recombinant Vaccinia Virus." J. Virol. 61(12):4019-4022 (Dec. 1987).
Zhang et al., "Immunization of Mice with Dengue Structural Proteins and Nonstructural Protein NS1 Expressed by Baculovirus Recombinant Induces Resistance to Dengue Virus Encephalitis." J. Virol. 62(8): 3027-3031(Aug. 1988).
Zhang et al., "Passive Protection of Mice, Goats, and Monkeys Against Japanese Encephalitis With Monoclonal Antibodies." J. Med. Virol. 29: 133-138 (1989).
Hennessy et al., "Effectiveness of live-attenuated Japanese encephalitis vaccine (SA14-14-2): a case-control study" Lancet 347:1583-1586 (Jun. 8, 1996).
Ho et al., "DNA vaccination induces a long-term antibody response and protective immunity against pseudorabies virus in mice." Arch. Viral. 143:115-125 (1998).
Hsiang-Chi Lee et al., "Dengue Type 4 Live-Attenuated Vaccine Viruses Passaged in Vero Cells Affect Genetic Stability and Dengue-Induced Hemorrhaging in Mice", PLOS ONE, vol. 6, No. 1 0, Oct. 28, 2011 (Oct. 28, 2011), p. e25800.
Huang et al., "Chimeric Dengue 2 PDK-53/West Nile NY99 Viruses Retain the Phenotypic Attenuation Markers of the Candidate PDK-53 Vaccine Virus and Protect Mice against Lethal Challenge with West Nile Virus," Journal of Virology, vol. 79, No. 12,pp. 7300-7310,2005.
Huang et al., "Chimeric Dengue Type 2 (Vaccine Strain PDK-53)/Dengue Type 1 Virus as a Potential Candidate Dengue Type 1 Virus Vaccine." J. Viral. 74(7):3020-3028 (Apr. 2000).
Huang et al., "Dengue 2 PDK-53 Virus as a Chimeric Carrier for Tetravalent Dengue Vaccine Development," Journal of Virology, vol. 77, No. 21, pp. 11436-11447, 2003.
Huang et al., "Genetic and Phenotypic Characterization of Manufacturing Seeds for a Tetravalent Dengue Vaccine (DENVax)", PLOS Neglected Tropical Diseases, vol. 7, No. 5, May 30, 2013 (May 30, 2013), p. e2243.

(56) References Cited

OTHER PUBLICATIONS

Hubalek et al., "West Nile Fever—a Reemerging Mosquito-Borne Viral Disease in Europe." Emerg. Infect. Dis. 5 (5):643-650 (Oct. 1999).
Hunt and Calisher., "Relationships of Bunyamwera Group Viruses by Neutralization." Am. J. Trop. Med. Hyg. 28 (4):740-749 (1979).
International Search Report issued in WO Application No. PCT/US2014/024603, mailed Nov. 5, 2014, 26 pages.
Jia et al., "Genetic analysis of West Nile New York 1999 encephalitis virus." Lancet 354:1971-1972 (Dec. 4, 1999).
Jirakanjanakit et al., "Dynamics of Susceptibility and Transmissibility of The Live, Attenuated, Candidate Vaccine Dengue-1 PDK-13, Dengue-3 PGK30F3, and Dengue-4 PDK-48 After Oral Infection in Aedes Aegypti." Am. J. Trop. Med. Hyg. 61(4):672-676 (1999).
Johnson et al., "Detection of Anti-ArboviralImmunoglobulin G by Using a Monoclonal Antibody-Based Capture Enzyme-Linked Immunosorbent Assay." J. C/in. Microbial. 38(5):1827-1831 (May 2000).
Johnson et al., "Growth Characteristics of ChimeriVax-DEN2 Vaccine Virus in Aedes Aegypti and Aedes Albopictus Mosquitoes." Am. J. Trop. Med. Hyg. 67(3):260-265 (2002).
Kanesa-thasan et al., "Safety and immunogenicity of attenuated dengue virus vaccines (Aventis Pasteur) in human volunteers." Vaccine 19:3179-3188 (2001).
Kawano et al., "Genetic Determinants of Dengue Type 4 Virus Neurovirulence for Mice." J. Viral. 67(11):6567-6575 (Nov. 1993).
Khin et al., "Infection, Dissemination, Transmission, and Biological Attributes of Dengue-2 PDK53 Candidate Vaccine Virus After Oral Infection in Aedes Aegypti." Am. J. Trop. Med. Hyg. 51(6):864-869 (1994).
Kimura-Kuroda et al., "Antigenic Comparison of Envelope Protein E between Japanese Encephalitis Virus and Some Other Flaviviruses Using Monoclonal Antibodies." J. Gen. Viral. 67:2663-2672 (1986).
Kimura-Kuroda et al., "Topographical Analysis of Antigenic Determinants on Envelope Glycoprotein V3 (E) of Japanese Encephalitis Virus, Using Monoclonal Antibodies." J. Viral. 45(1):124-132 (Jan. 1983).
Kinney et al., "Construction of Infectious eDNA Clones for Dengue 2 Virus: Strain 16681 and Its Attenuated Vaccine Dervative, Strain PDK-53." Virology 230(2):300-308 (1997).
Kinney and Huang., "Development of New Vaccines against Dengue Fever and Japanese Encephalitis." Intervirology 14:176-197 (2001}.
Klinman et al., "CpG motifs as immune adjuvants." Vaccine 17: 19-25 (1999).
Kochel et al., "Inoculation of plasmids expressing the dengue-2 envelope gene elicit neutralizing antibodies in mice." Vaccine H)(5):547-552 (1997).
Kohler et al., "Continuous cultures of fused cells secreting antibody of predefined specificity." Nature 256:495-497 (Aug. 7, 1975).
Konishi et al., "Avipox virus-vectored Japanese encephalitis virus vaccines: use as vaccine candidates in combination with purified subunit immunogens." Vaccine 12(7):633-638 (1994).
Konishi et al., "Comparison of Protective Immunity Elicited by Recombinant Vaccinia Viruses That Synthesize E or NS1 of Japanese Encephalitis Virus." Virology 185:401-410 (1991).
Konishi et al., "Generation and Characterization of a Mammalian Cell Line Continuously Expressing Japanese Encephalitis Virus Subviral Particles." J. Viral. 75(5): 2204-2212 (Mar. 2001).
Konishi et al., "Induction of Protective Immunity against Japanese Encephalitis in Mice by Immunization with a Plasmid Encoding Japanese Encephalitis Virus Premembrane and Envelope Genes." J. Virol. 72(6):4925-4930 (Jun. 1998).
Konishi et al., "Mice Immunized with a Subviral Particle Containing the Japanese Encephalitis Virus prM/M and E Proteins Are Protected from Lethal JEV Infection." Virology 188:714-720 (1992).

Kozak., "Circumstances and Mechanisms of Inhibition of Translation by Secondary Structure in Eucaryotic mRNAs." Mol. Cell. Bioi. 9(11):5134-5142 (Nov. 1989).
Kuno et al., "Phylogeny of the Genus Flavivirus." J. Virol. 72(1):73-83 (Jan. 1998).
Laemmli., "Cleavage of Structural Proteins during the Assembly of the Head of Bacteriophage T4." Nature 227:680-685 (Aug. 15, 1970).
Lai et al., "Immunization of Monkeys with Baculovirus Recombinant-expressed Dengue Envelope and NS1 Glycoproteins Induces Partial Resistance to Challenge with Homotypic Dengue Virus." In Vaccines 90: Modern Approaches to New Vaccines including Prevention of AIDS, .Cold Spring Harbor Laboratory, Cold Springs Harbor, NY pp. 119-124 (1990).
Lai et al., "Evaluation of molecular strategies to develop a live dengue vaccine." Clin. Diagn. Viral. 1 0:173-179 (1998).
Lanciotti et al., "Origin of the West Nile Virus Responsible for an Outbreak of Encephalitis in the Northeastern United States." Science 286:2333-2337 (Dec. 17, 1999).
Liljestrom et al., "In vitro Mutagenesis of a Full-Length eDNA Clone of Semliki Forest Virus: the Small 6,000-Molecular-Weight Membrane Protein Modulates Virus Release." J. Viral. 65(8):4107-4113 (Aug. 1991).
Lin in et al., "DNA Immunization with Japanese Encephalitis Virus Nonstructural Protein NS1 Elicits Protective Immunity in Mice." J. Viral. 72(1}:191-200 (Jan. 1998).
Mackow et al., "The Nucleotide Sequence of Dengue Type 4 Virus: Analysis of Genes Coding for Nonstructural Proteins." Virology 159:217-228 (1987).
Mandl et al., "Complete Genomic Sequence of Powassan Virus: Evaluation of Genetic Elements in Tick-Borne versus Mosquito-Borne Flaviviruses." Virology 194:173-184 (1993).
Martin et al., "Standardization of Immunoglobulin M Capture Enzyme-Linked Immunosorbent Assays for Routine Diagnosis of Arboviral Infections." J. Clin. Microbial. 38(5): 1823-1826 (May 2000).
Mason et al., "Sequence of the Dengue-1 Virus Genome in the Region Encoding the Three Structural Proteins and the Major Nonstructural Protein NS1." Virology 161:262-267 (1987).
Mason et al., "Japanese Encephalitis Virus-Vaccinia Recombinants Produce Particulate Forms of the Structural Membrane Proteins and Induce High Levels of Protection against Lethal JEV Infection." Virology 180:294-305 (1991).
Men et al., "Dengue Type 4 Virus Mutants Containing Deletions in the 3' Noncoding Region of the RNA Genome: Analysis of Growth Restriction in Cell Culture and Altered Viremia Pattern and Immunogenicity in Rhesus Monkeys." J. Virol. 70(6):3930-3937 (Jun. 1996).
Mir et al., "High-efficiency gene transfer into skeletal muscle mediated by electric pulses." Proc. Nat. Acad. Sci. USA 6:4262-4267 (Apr. 1999).
Monath et al., "Recombinant, chimeric live, attenuated vaccine (ChimeriVax) incorporating the envelope genes of Japanese encephalitis (SA14-14-2) virus and the capsid and nonstructural genes of yellow fever (17D) virus is safe, immunogenic and protective in non-human primates." Vaccine 17:1869-1882 (1999).
Nitayaphan et al., "Nucleotide Sequence of the Virulent SA-14 Strain of Japanese Encephalitis Virus and Its Attenuated Vaccine Derivative, SA-14-14-2." Virology 177:541-552 (1990).
Nowak et al: "Analyses of the terminal 4 sequences of west nile virus structural proteins and of the in vitro translation of these proteins allow the proposal of a complete scheme of the proteolytic cleavages involved in their synthesis", Virology, Academic Press. Orlando, US. vol. 169, No. 2, Apr. 1, 1989 (Apr. 1, 1989) pp. 365-376.
Osatomi and Sumiyoshi, "Complete Nucleotide Sequence of Dengue Type 3 Virus Genome RNA." Virology 176:643-647 (1990).
Osatomi et al., "Nucleotide Sequence of Dengue Type 3 Virus Genomic RNA Encoding Viral Structural Proteins." Virus Genes 2(1):99-108 (1988).

(56) References Cited

OTHER PUBLICATIONS

Osorio et al: "Development of DENVax: A chimeric dengue-2 PDK-53-based tetravalent vaccine for protection against dengue fever", Vaccine, vol. 29, No. 42, Jul. 21, 2011 (Jul. 21, 2011), pp. 7251-7260.
Aberle et al., "A DNA Immunization Model Study with Constructs Expressing the Tick-Borne Encephalitis Virus Envelope Protein E in Different Physical Forms." J. Immunol. 163:6756-6761 (1999).
Allison et al., "Synthesis and Secretion of Recombinant Tick-Borne Encephalitis Virus Protein E in Soluble and Particulate Form." J. Virol. 69(9): 5816-5820 (Sep. 1995).
Alvarez et al. "A Phase I Study of Recombinant Adenovirus Vector-Mediated Delivery of an Anti-erbB-2 Single-Chain (sFv) Antibody Gene for Previously Treated Ovarian and Extraovarian Cancer Patients." Hum. Gene Ther. 8:229-242 (Jan. 20, 1997).
Anderson et al., "Isolation of West Nile Virus from Mosquitoes, Crows, and a Cooper's Hawk in Connecticut" Science 286:2331-2333 (Dec. 17, 1999).
Arroyo et al., "Molecular Basis for Attenuation of Neurovirulence of a Yellow Fever Virus/Japanese Encephalitis Virus Chimera Vaccine (ChimeriVax-JE)." J. Virol. 75(2):934-942 (Jan. 2001).
Asnis et al., "The West Nile Virus Outbreak of 1999 in New York: The Flushing Hospital Experience." Clin. Infect. Dis. 30: 413-418 (2000).
Azevedo et al., "Main features of DNA-based immunization vectors." Braz. J. Med. Bioi. Res. 32(2):147-153 (1999).
Bhamarapravati et al., "Immunization with a live attenuated dengue-2-virus candidate vaccine (16681-PDK 53): clinical, immunological and biological responses in adult volunteers." Bull World Health Organ. 65(2):189-195 (1987).
Bhamarapravati and Sutee. "Live attenuated tetravalent dengue vaccine." Vaccine 18:44-47 (2000).
Bhamarapravati and Yoksan. "Live Attenuated Tetravalent Vaccine," In Dengue and Dengue Hemorrhagic Fever, D.J. Gubler and G. Kuno (ed), Cab International, Wallingford, OX, UK p. 367-377 (1997).
Bhatt et al., "Growth Characteristics of the Chimeric Japanese Encephalitis Virus Vaccine Candidate, ChimeriVax-JE (YF/JE SA14-14-2), In Culex tritaeniorhynchus, Aedes albopictus, and Aedes aegypti Mosquitoes." Am. J. Trop. Med. Hyg. 62(4):480-484 (2000).
Blok et al., "Comparison of a Dengue-2 Virus and Its Candidate Vaccine Derivative. Sequence Relationships with the Flaviviruses and Other Viruses." Virology 187:573-590 (1992).
Bray et al., "Mice Immunized with Recombinant Vaccinia Virus Expressing Dengue 4 Virus Structural Proteins with or without Nonstructural Protein NS 1 Are Protected against Fatal Dengue Virus Encephalitis." J. Viral. 63(6): 2853-2856 (Jun. 1989).
Bray et al., "Monkeys Immunized with Intertypic Chemeric Dengue Viruses Are Protected against Wild-Type Virus Challenge." J. Virol. 70(6):4162-4166 (Jun. 1996).
Bray and Lai., "Construction of intertypic chimeric dengue viruses by substitution of structural protein genes." Proc. Nat/. Acad. Sci. USA 88:10342-10346 (Nov. 1991).
Butpret et al., "Attenuation Markers of a Candidate Degue Type 2 Vaccine Virus, Strain 16681 (PDK-53), Are Defined by Mutations in the 5' Noncoding Region and Nonstructural Proteins 1 and 3." J. Virol. 7 4(7):3011-3019 (Apr. 2000).
Butrapet et al., "Chimeric Dengue Type 2/Type 1 Viruses Induce Immune Responses in Cynomolgus Monkeys." Southeast Asian J. Trap. Med. Public Health 33(3):589-599 (Sep. 2002).
Butrapet, et al., "Determining genetic stabilities of chimeric dengue vaccine candidates based on dengue 2 PDK-53 virus by sequencing and quantitative TaqMAMA", Journal ofVirol. Methods, vol. 131, No. 1, pp. 1-9, 2006.
Cahour et al., "Growth-Restricted Dengue Virus Mutants Containing Deletions in the 5' Noncoding Region of the RNA Genome." Virology 207:68-76 (1995).

Calvert, et al., "Non-structural proteins of dengue 2 virus offer limited protection to interferon-deficient mice after dengue 2 virus challenge", Journal of General Virology, vol. 87, pp. 339-346, 2006.
Caufour et al., "Construction, characterization and immunogenicity of recombinant yellow fever 17D-dengue type 2 viruses," Virus Research vol. 79, pp. 1-14, 2001.
Chambers et al., "Yellow Fever/Japanese Encephalitis Chimeric Viruses: Construction and Biological Properties." J. Viral. 73(4):3095-3101 (Apr. 1999).
Chambers et al., "Fiavivirus Genome Organization, Expression, and Replication." Annu. Rev. Microbial. 44:649-688 (1990).
Chambers et al., "Yellow Fever Virus/Dengue-2 Virus and Yellow Fever Virus/Dengue-4 Virus Chimeras: Biological Characterization, Immunogenicity, and Protection against Dengue Encephalitis in the Mouse Model." J. Virol. 7 (6):3655-3668 (Mar. 2003).
Chang et al., "A Single Intramuscular Injection of Recombinant Plasmid DNA Induces Protective Immunity and Prevents Japanese Encephalitis in Mice." J. Virol. 74(9):4244-4252 (May 2000).
Chen et al., "Construction of Intertypic Chimeric Dengue Viruses Exhibiting Type 3 Antigenicity and Neurovirulence for Mice." J. Virol. 69(8):5186-5190 (Aug. 1995).
Clarke and Casals. "Techniques for Hemagglutination and Hemagglutination-Inhibition With Arthropod-Borne Viruses." Am. J. Trop. Med. Hyg. 7:561-573 (1958).
Database UniProt [Online] Apr. 1, 1993 (Apr. 1, 1993), "RecName: Fuii=Genome polyprotein; Contains: RecName: Fuii=Capsid protein C; AltName: Fuii=Core protein; Contains: RecName: Full=prM; Contains:", XP002731514, -etrieved from EBI accession No. UNIPROT: P29991 Database accession No. P29991.
Database UniProt [Online] Nov. 1, 1999 (Nov. 1, 1999), "SubName: Fuii=DEN polyprotein {EC0:00003131 EMBL: AAC40836.1};", XP002731515, retrieved from EBI accession No. UNIPROT: Q9WLZ7 Database accession No. Q9WLZ7.
Database UniProt [Online] Feb. 9, 2010 (Feb. 9, 2010), "SubName: Fuii=Polyprotein {EC0:00003131 EMBL: ADA00411.1};", XP002731516, retrieved from EBI accession No. UNIPROT: D2KQW7 Database accession No. Q2KQW7.
Davis et al., "West Nile Virus Recombinant DNA Vaccine Protects Mouse and Horse from Virus Challenge and Expresses in Vitro a Noninfectious Recombinant Antigen That Can Be Used in Enzyme-linked Immunosorbent Assays." J. Virol. 75(9):4040-4047 (May 2001).
Deubel et al., "Nucleotide Sequence and Deduced Amino Acid Sequence of the Nonstructural Proteins of Dengue Type 2 Virus, Jamaica Genotype: Comparative Analysis of the Full-Length Genome." Virology 165:234-244 (1988).
Deubel et al., "Nucleotide Sequence and Deduced Amino Acid Sequence of the Structural Proteins of Dengue Type 2 Virus, Jamaica Genotype." Virology 155:365-377 (1986).
Dharakul et al., "Dengue Virus-Specific Memory T Cell Responses in Human Volunteers Receiving a Live Attenuated Dengue Virus Type 2 Candidate Vaccine." J. Infect. Dis. 170:27-33 (1994).
Dmitriev et al., "Immunization with recombinant vaccinia viruses expressing structural and part of the nonstructural region of tick-borne encephalitis virus eDNA protect mice against lethal encephalitis." J. Biotechnol. 44:97-103 (1996).
Duarte dos Santos et al., "Complete nucleotide sequence of yellow fever virus vaccine strains 17DD and 17D-213." Virus Res. 35:35-41 (1995).
Durbin et al., "Attenuation and Immunogenicity in Humans of a Live Dengue Virus Type-4 Vaccine Candidate With a 30 Nucleotide Delection in Its 3'-Untranslated Region." Am. J. Trop. Med. Hyg. 65(5):405-413 (2001).
Falgout et al., "Immunization of Mice with Recombinant Vaccinia Virus Expressing Authentic Dengue Virus Nonstructural Protein NS1 Protects against Lethal Dengue Virus Encephalitis." J. Virol. 64(9):4356-4363 (Sep. 1990).
Falgout et al., "Proper Processing of Dengue Virus Nonstructural Glycoprotein NS1 Requires the N-terminal Hydrophobic Signal Sequence and the Downstream Nonstructural Protein NS2a." J. Virol. 63(5):1852-1860 (May 1989).

(56) References Cited

OTHER PUBLICATIONS

Garmendia et al., "Recovery and Identification of West Nile Virus from a Hawk in Winter." J. Clin. Microbiol. 38(8):3110-3111 (Aug. 2000).

Gruenberg et al., "Partial Nucleotide Sequence and Deduced Amino Acid Sequence of the Structural Proteins of Dengue Virus Type 2, New Guinea C and PU0-218 Strains." J. Gen. Virol. 69:1391-1398 (1988).

Guriakhoo et al., "Construction, Safety, and Immunogenicity in Nonhuman Primates of a Chimeric Yellow Fever-Dengue Virus Tetravalent Vaccine." J. Virol. 75(16):7290-7304 (Aug. 2001).

Guirakhoo et al., "Immunogenicity, Genetic Stability, and Protective Efficacy of a Recombinant, Chimeric Yellow Fever-Japanese Encephalitis Virus (ChimeriVax-JE) as a Live, Attenuated Vaccine Candidate against Japanese Encephalitis." Virology 257:363-372 (1999).

Guirakhoo et al.: "Recombinant chimeric yellow fever-dengue type 2 virus is immunogenic and protective in nonhuman primates". Journal of Virology. The American Society for Microbiology. US. vol. 74. No. 12. Jun. 1, 2000 (Jun. 1, 2000). pp. 5477-5485.

Guirakhoo et al., "Viremia and Immunogenicity in Nonhuman Primates of a Tetravalent Yellow Fever-Dengue Chimeric Vaccine: Genetic Reconstructions, Dose Adjustment, and Antibody Responses Against Wild-type Dengue Virus Isolates." Virology 298: 146-159 (2002).

Hahn et al., "Nucleotide Sequence of Dengue 2 RNA and Comparison of the Encoded Proteins with Those of Other Flaviviruses." Virology 162:167-180 (1988).

Halstead and Simasthien. "Observations Related to the Pathogenesis of Dengue Hemorrhagic Fever. II. Antigenic and Biologic Properties of Dengue Viruses and Their Association With Disease Response in The Host." Yale J. Bioi. Med. 42:276-292 (Apr. 1970).

Hashimoto et al., "Molecular Cloning and Complete Nucleotide Sequence of the Genome of Japanese Encephalitis Virus Beijing-1 Strain." Virus Genes 1(3):305-317 (1988).

Heinz and Roehrig, Flaviviruses. Immunochemistry of Viruses II: The Basis for Serodiagnosis and Vaccines (edited by von Regenmortel and Neurath) Elsevier Science Publishers Chapter 14, pp. 289-305 (1990).

Henchal et al., "Dengue Virus-Specific and Flavivirus Group Determinants Identified With Monoclonal Antibodies by Indirect Immunofluorescence." Am. J. Trop. Med. Hyg. 31(4):830-836 (1982).

Osorio, Jorge E et al., Efficacy of a Tetravalent Chimeric Dengue Vaccine (DENVax) in Cynomolgus Macaques, Am.J. Trop.Med. Hyg., vol. 84, No. 6, (2011) pp. 978-987.

| Serotype | Strain | virus origin | C57T | A524T | T900C[a] | C2055T | G2579A | C4018T | A5220T | T5547C | G6599C | C8571T |
|---|---|---|---|---|---|---|---|---|---|---|---|---|
| | | | 5'NCR | prM-D29V | M (silent) | E (silent) | NS1-G53D | NS2A-L181 | NS3-E250V | NS3(silent) | NS4A-G75A | NS5(silent) |
| DENV-2 | 16681 | isolate from human | C | A | T | C | G | C | A | T | G | C |
| | PDK-53 | PDK cell pass of 16681 | T | T | - | t | A | T | T/A mix | c | C | t |
| | PDK53-V(VV45R) | Recombinant PDK-53-V | T | T | c | t | A | T | T | c | C | c |
| | PDK53-E(VE48R) | Recombinant PDK-53-E | T | T | c | t | A | T | A | c | C | c |

Underlined Mutations: the 3 most important attenuation loci of PDK-53
Red font: PDK-53 specific sequence (change from 16681)
Bold font: Different nt sequence between PDK-53 and clone-derived V or E virus
[a] Engineered silent clone marker to differenciate original PDK-53 and recombinant (clone-derived) viruses

COMPOSITIONS AND METHODS FOR DENGUE VIRUS CHIMERIC CONSTRUCTS IN VACCINES

PRIORITY

This PCT application claims priority to U.S. Provisional Application No. 61/800,204 filed Mar. 15, 2013. This application is incorporated herein in its entirety by reference for all purposes.

FEDERALLY FUNDED RESEARCH

This invention was made with Government support under R43 AI084291 awarded by the National Institutes of Health. The Government has certain rights in this invention.

FIELD

Embodiments herein report compositions, methods, uses and manufacturing procedures for dengue virus constructs and vaccine compositions thereof. Some embodiments concern a composition that includes, but is not limited to, chimeric flavivirus virus constructs that alone or in combination with other constructs can be used in a vaccine composition. In certain embodiments, compositions can include constructs of more than one serotypes of dengue virus, such as dengue-1 (DEN-1) virus, dengue-2 (DEN-2) virus, dengue-3 (DEN-3) virus and/or dengue-4 (DEN-4) virus. In other embodiments, manufacturing strategy that can improve the safety and genetic stability of recombinant live-attenuated chimeric dengue vaccine (DENVax) viruses. Certain embodiments include at least one live, attenuated dengue virus in combination with dengue virus chimeric constructs identified to be both safe and effective in vaccine compositions where the constructs have undergone additional passages in cell cultures.

BACKGROUND

Infection with dengue virus can lead to a painful fever of varying severity. To date, four serotypes of dengue virus have been identified: dengue-1 (DEN-1), dengue-2 (DEN-2), or dengue-3 (DEN-3) in combination with dengue-4 (DEN-4). Dengue fever is caused by infection of a dengue virus. Other subtypes may be discovered in the future (e.g. DEN-5). Dengue virus serotypes 1-4 can also cause dengue hemorrhagic fever (DHF), and dengue shock syndrome (DSS). The most severe consequences of infection, DHF and DSS, can be life threatening. Dengue viruses cause 50-100 million cases of debilitating dengue fever, 500,000 cases of DHF/DSS, and more than 20,000 deaths each year. To date, there is no effective vaccine to protect against dengue fever and no drug treatment for the disease. Mosquito control efforts have been ineffective in preventing dengue outbreaks in endemic areas or in preventing further geographic spread of the disease. It is estimated that 3.5 billion people are threatened by infection with dengue virus. In addition, dengue virus is a leading cause of fever in travelers to endemic areas, such as Asia, Central and South America, and the Caribbean.

All four dengue virus serotypes are endemic throughout the tropical regions of the world and constitute the most significant mosquito-borne viral threat to humans in tropical regions, worldwide. Dengue viruses are transmitted to humans primarily by *Aedes aegypti* mosquitoes. Infection with one dengue virus serotype results in life-long protection from re-infection by that serotype, but does not prevent secondary infection by one of the other three dengue virus serotypes. In fact, previous infection with one dengue virus serotype leads to an increased risk of severe disease (DHF/DSS) upon secondary infection with a different serotype. The development of an effective vaccine represents an important approach to the prevention and control of this global emerging disease. Multiple immunizations make complete vaccine coverage difficult both for public health efforts in dengue virus endemic countries as well as travelers.

SUMMARY

Embodiments herein concern compositions, methods and uses of chimeric dengue virus constructs. In some embodiments, a composition can include chimeric dengue virus constructs having an attenuated dengue virus backbone with structural genes from at least one other dengue virus serotype. Other embodiments concern at least one live, attenuated virus in combination with one or more chimeric dengue viruses. Other embodiments can include a composition of chimeric dengue viruses having a modified DEN-2 backbone (e.g. PDK-53 as a starting backbone in P1 (passage-1) and passage variability (after passage and growth in vitro on a permissive cell line) as indicated for P2, P3, . . . P8 . . . P10 etc.) and one or more structural components of DEN-1, DEN-2, DEN-3 or DEN-4. In other embodiments, an immunogenic composition is generated where when introduced to a subject, the composition produces an immune response to one or more dengue viruses in the subject. Therefore, constructs contemplated herein can be generated and passaged in vitro, and each of the passages provides an attenuated dengue virus contemplated of use in a pharmaceutically acceptable vaccine composition. In certain embodiments a live, attenuated virus can be a live, attenuated dengue-2 virus alone or in combination with one or more chimeric dengue viruses.

In certain examples, chimeric dengue virus constructs of dengue virus serotypes can include passage 7 (P7) live, attenuated viruses or chimeric viruses having nucleic acid sequences identified by SEQ ID NOS: 1, 9, 17 and 25 or polypeptide sequences indicated by SEQ ID NOS: 2, 10, 18 and 26. It is contemplated herein that any of the passages for any of the live, attenuated viruses described herein can be used in an immunogenic composition to induce immune responses to the represented dengue viruses (e.g. serotypes 1-4). In accordance with these embodiments, an immunogenic composition that includes a P-8 isolated live, attenuated virus can be administered to a subject to induce an immunogenic response against one or more dengue virus serotypes depending on the construct selected. In addition, a live, attenuated virus can be combined with one or more of these chimeric viruses. This is contemplated for each of the live, attenuated viruses isolated/produced in each subsequent cell passages (e.g. African Green Monkey Vero cell production, hereinafter: Vero cells). It is contemplated herein that any cell line (e.g. GMP-produced cell bank, FDA or EMA-approved) capable of producing dengue viruses is of use to passage any of the viral constructs at a manufacturing scale or as appropriate contemplated herein for subsequent use in a vaccine or immunogenic composition against Dengue virus.

In other embodiments, compositions contemplated herein can be combined with other immunogenic compositions against other Flaviviruses such as West Nile virus, Japanese encephalitis or any other flavivirus chimeric construct and/or live, attenuated virus. In certain embodiments, a single composition can be used against multiple flaviviruses.

In certain embodiments, an immunogenic composition of the present invention can include chimeric dengue viruses against one or more of DEN-1, DEN-2, DEN-3 and/or DEN-4, alone or in combination with a live, attenuated dengue virus composition.

In other embodiments, a construct can include a construct having adaptive mutations in the structural or non-structural regions of the virus that increase growth or production without affecting attenuation or safety of the virus when introduced to a subject. In certain embodiments, any of the contemplated chimeric dengue virus constructs can include a live, attenuated DEN-2 virus having specific mutations used as a backbone where the live attenuated DEN-2 PDK virus further includes structural proteins of one or more of prM (premembrane) and E (envelope) structural proteins of the other dengue virus serotypes. In addition, a DEN-2 backbone can include additional mutations in order to increase production of or enhance the immune response to a predetermine composition in a subject upon administration (e.g. chimeric Dengue virus 2/1, 2/3 or 2/4).

In some embodiments, structural protein genes can include prM and E genes of DEN-1, DEN-2, DEN-3 or DEN-4 on a DEN-2 backbone having one or two mutations that are part of a live, attenuated dengue virus. For example, a dengue construct, in certain embodiments can include those constructs termed DENVax-1-A, DENVax-2-F, DENVax-3-F, and DENVax-4-F (see Example section) where the DEN-2 backbone has one or more mutations (e.g. not found in the P1 or other previous passaged virus or PDK-53) from the DEN-2 live, attenuated virus previously demonstrated to be safe and effective to induce an immune response. The DEN-2 live, attenuated virus of the instant application is an improved version of the originally used DEN-2 live, attenuated virus. A chimeric construct of the instant invention can include a modified attenuated DEN-2 PDK-53 backbone, having one or more structural proteins of the second dengue virus serotype wherein the structural proteins can include additional mutations to increase an immunogenic response to the chimeric construct. In some embodiments, certain mutations acquired by attenuated DEN-2 PDK-53 can produce a conservative amino acid change or not in a constructs different from the P1 construct which can result in desirable traits for production etc.

In other embodiments, a live, attenuated DEN-2 genome can be used to generate constructs of dengue virus serotype 1 (DEN-1) and dengue virus serotype 3 (DEN-3), dengue virus serotype 4 (DEN-4) where one or more structural protein genes of the DEN-2 viral genome can be replaced by one or more structural protein genes of DEN-1, DEN-3 or DEN-4, respectively. In some embodiments, a structural protein can be the C, prM or E protein of a second dengue virus. In certain embodiments, structural protein genes include the prM and E genes of DEN-1, DEN-3 or DEN-4. These hybrid viruses express the surface antigens of DEN-1, DEN-3 or DEN-4 while retaining the attenuation phenotypes of the parent attenuated DEN-2.

Constructs disclosed herein can include chimeric constructs of DEN-4, DEN-2, DEN-1, and DEN-3 expressing surface antigens of DEN-1, DEN-3 and DEN-4 using attenuated DEN-2 virus as a backbone.

In certain embodiments, compositions of the instant invention can include a composition that comprises a single chimeric dengue virus construct disclosed herein and a pharmaceutically acceptable carrier or excipient. Alternatively, compositions of the instant invention can include a composition that comprises two or more, or three or more chimeric dengue virus constructs disclosed herein, and a pharmaceutically acceptable carrier or excipient. In accordance with these embodiments, a one or more dengue virus chimeric constructs contemplated herein can be combined with one or more, live attenuated dengue viruses. In certain embodiments, a live, attenuated virus can be a live, attenuated DEN-2 virus wherein additional mutations in the NCR, NS1 regions or other regions increase the immune response, increase viral growth or other improvement for an improved live, attenuated dengue virus.

In certain embodiments, the attenuation loci, nucleotide 5'NCR-57-T, NS1-53-Asp, and NS3-250-Val, of the DENV-2 vaccine have been previously determined, and all of these changes are shared by the common PDK-53 virus-specific genetic background of the four DENVax viruses. The genetic sequence of the three attenuation loci as well as the previously established in vitro and in vivo attenuation phenotypes of these vaccine candidates were carefully monitored for the cGMP-manufactured DENVax seeds. This report describes strategies used to generate master virus seeds (MVS) as well as their genetic and phenotypic characterization of use in the manufacture of dengue virus vaccine compositions. These MVS can be used for manufacture of clinical materials and ultimately commercial vaccine supplies.

BRIEF DESCRIPTION OF THE DRAWINGS

The following drawings form part of the present specification and are included to further demonstrate certain embodiments. Some embodiments may be better understood by reference to one or more of these drawings alone or in combination with the detailed description of specific embodiments presented.

Figure 1:
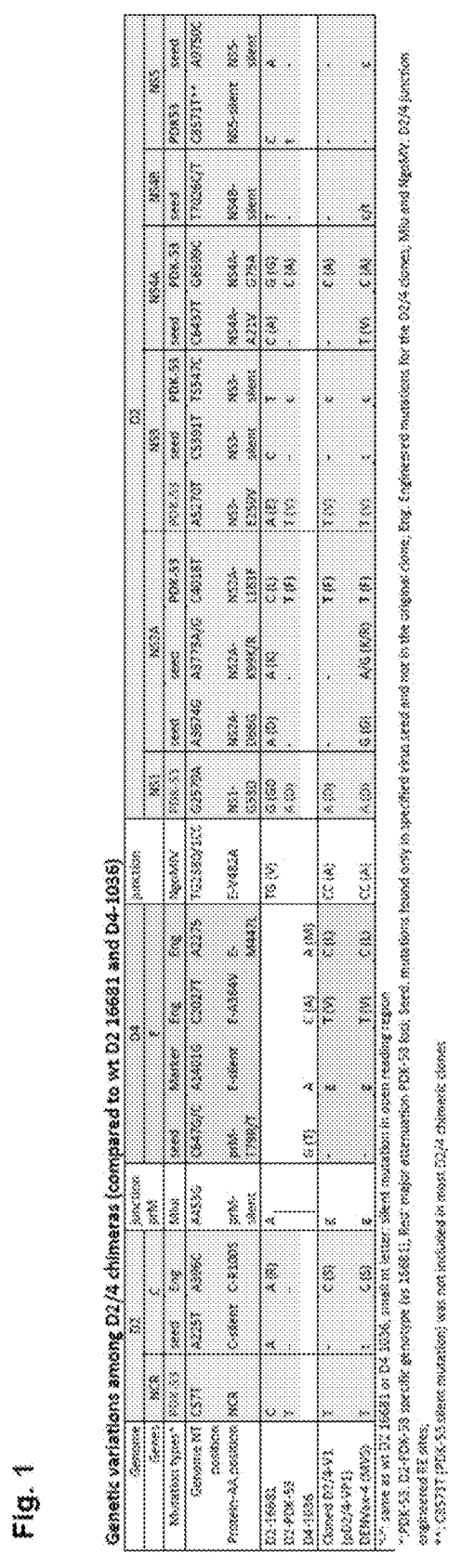

FIG. 1 represents an exemplary chart reflecting an exemplary chimeric construct of the instant invention, DEN-2/DEN-4 compared to previously generated constructs and wild type dengue viruses.

FIG. 2 represents an exemplary histogram plot comparing various responses using a live, attenuated DEN-2 backbone (with additional mutations) and a second dengue virus serotype substituted for the dengue-2 structural components (e.g. DENVax-1 MVS). This plot illustrates plaque sizes of the DENVax MVS. Wild-type Dengue viruses and previously published research-grade vaccine candidate viruses were included for control and comparison. This plot illustrates improved production of the dengue virus constructs compared to control dengue virus chimeric constructs.

FIG. 3 represents an exemplary histogram plot that represents temperature sensitivities of DENVax MVS (Master Virus Seed). Wild type dengue viruses and previously published research-grade vaccine candidate viruses were included for comparison with the MVS grade.

FIG. 8 represents an exemplary histogram plotting restricted growth of DENVax MVS, WVS, and BVS in C6/36 cells. Mean titers±SD (error bars) of the viruses replicated in C6/36 cells 7 days pi. The wt Dengue viruses and previously published research-grade vaccine candidate viruses were included for comparison.

FIG. 10 represents an exemplary chart comparing new live, attenuated viruses to previously generated live, attenuated dengue viruses.

DEFINITIONS

Figure 4:
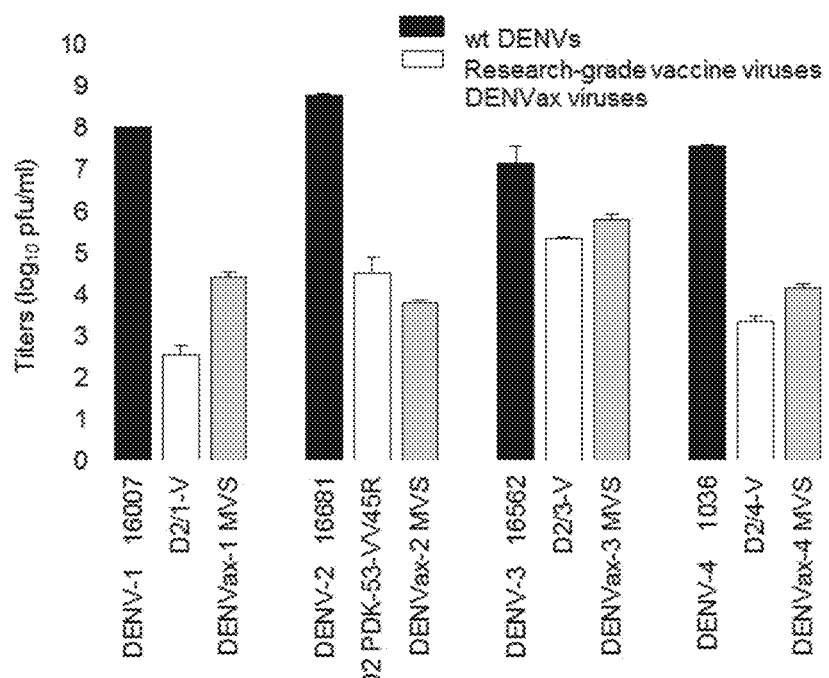
FIG. 4 represents an exemplary histogram plot that represents viral growth of DENVax MVS in C6/36 cells compared to controls. Wild-type dengue viruses and research-grade vaccine candidate viruses were included for comparison with the DENVax MVS.

As used herein, "a" or "an" may mean one or more than one of an item.

As used herein the specification, "subject" or "subjects" may include, but are not limited to, mammals such as humans or mammals, domesticated or wild, for example dogs, cats, other household pets (e.g. hamster, guinea pig, mouse, rat), ferrets, rabbits, pigs, horses, cattle, prairie dogs, wild rodents, or zoo animals.

As used herein, the terms "virus chimera," "chimeric virus," "flavivirus chimera" and "chimeric flavivirus" can mean a construct comprising a portion of the nucleotide sequence of a dengue-2 virus and further nucleotide sequence that is not from dengue-2 virus or is from a different flavivirus. A "dengue chimera" comprises at least two different dengue virus serotypes but not a different flavivirus. Thus, examples of other dengue viruses or flaviviruses include, but are not limited to, sequences from dengue-1 virus, dengue-3 virus, dengue-4 virus, West Nile virus, Japanese encephalitis virus, St. Louis encephalitis virus, tick-borne encephalitis virus, yellow fever virus and any combination thereof.

As used herein, "nucleic acid chimera" can mean a construct of the invention comprising nucleic acid comprising a portion of the nucleotide sequence of a dengue-2 virus and further nucleotide sequence that is not of the same origin as the nucleotide sequence of the dengue-2 virus. Correspondingly, any chimeric flavivirus or flavivirus chimera disclosed herein can be recognized as an example of a nucleic acid chimera.

As used herein, "a live, attenuated virus" can mean a wild-type virus, mutated or selected for traits of use in vaccine or other immunogenic compositions wherein some traits can include reduced virulence, safety, efficacy or improved growth etc.

DESCRIPTION

In the following sections, various exemplary compositions and methods are described in order to detail various embodiments. It will be obvious to one skilled in the art that practicing the various embodiments does not require the employment of all or even some of the specific details outlined herein, but rather that concentrations, times and other specific details may be modified through routine experimentation. In some cases, well-known methods or components have not been included in the description.

In accordance with embodiments of the present invention, there may be employed conventional molecular biology, protein chemistry, microbiology, and recombinant DNA techniques within the skill of the art. Such techniques are explained fully in the literature. See, e.g., Sambrook, Fritsch & Maniatis, Molecular Cloning: A Laboratory Manual, Second Edition 1989, Cold Spring Harbor Laboratory Press, Cold Spring Harbor, N.Y.; Animal Cell Culture, R. I. Freshney, ed., 1986).

Embodiments herein concern compositions, methods and uses for inducing immune responses against one or more dengue virus serotypes in a subject, individually or simultaneously. In accordance with these embodiments, attenuated dengue viruses and nucleic acid chimeras are generated and used in vaccine compositions disclosed herein. Some embodiments concern modified or mutated dengue constructs or chimeras. Other embodiments concern introducing mutations to modify the amino acid sequences of structural proteins of dengue viruses wherein the mutation increase immunogenicity to the virus.

Live, attenuated dengue viruses of all four serotypes have been developed by passaging wild-type viruses in cell culture. These are some of the most promising live, attenuated vaccine candidates for immunization against flavivirus and in particular dengue virus infection and/or disease. These vaccine candidates have been designated by a combination of their dengue serotype, the cell line through which they were passaged and the number of times they were passaged. Thus, a dengue serotype 1 wild-type virus passaged in PDK cells 13 times is designated as DEN-1 PDK-13 virus. Other vaccine candidates are DEN-2 PDK-53, DEN-3 PGMK-30/FRhL-3 (e.g. thirty passages in primary green monkey kidney cells, followed by three passages in fetal rhesus lung cells and DEN-4 PDK-48). These four candidate vaccine viruses were derived by tissue culture passage of wild-type parental DEN-1 16007, DEN-2 16681, DEN-3 16562 and DEN-4 1036 viruses, respectively.

In certain embodiments, live, attenuated dengue-2 PDK-53 vaccine virus contained a mixture of viruses, with the population containing varying nucleotide differences. After genetic characterization of the attenuating mutations, certain attenuating characteristics were outlined and engineered into a cDNA infectious clone. RNA was transcribed from this infectious clone and introduced into Vero cells as a passage 1 of the newly characterized and derived PDK-53-Vero-DEN-2-P 1 virus (see for example, Table 1). This attenuated virus was created for each DEN serotype, but for DEN-1, DEN-3 and DEN-4, the prM and E genes were engineered into 3 separate cDNA infectious clones, thus generating four separate PDK-53-Vero viruses (termed herein as: PDK-53-Vero-DEN-2-P 1, PDK-53-Vero-DEN-1-P 1, PDK-53-Vero-DEN-3-P 1, and PDK-53-Vero-DEN-4-P 1). These attenuated vaccine virus strains were passaged in Vero cells 10 times (Table 1), and each separate lineage acquired mutations upon their adaptation to grow in Vero cells (Table 3). Certain embodiments here are directed to derivation and uses for these live, attenuated dengue viruses.

Previous human clinical trials with these attenuated viruses have indicated that DEN-2 PDK-53 has the lowest infectious dose (50% minimal infectious dose of 5 plaque forming units or PFU) in humans, is strongly immunogenic, and produces no apparent safety concerns. The DEN-1 PDK-13, DEN-3 PGMK-30/FRhL-3 and DEN-4 PDK-48 vaccine virus candidates have higher 50% minimal infectious doses of 10,000, 3500, and 150 PFU, respectively, in humans. Although only one immunization with monovalent DEN-2 PDK-53 virus or DEN-4 PDK-48 virus was required to achieve 100% seroconversion in human subjects, a booster was needed to achieve the same seroconversion rate for DEN-1 PDK-13 and DEN-3 PGMK-30/FRhL-3 viruses, which have the two highest infectious doses for humans.

DEN-2 PDK-53 virus vaccine candidate, also abbreviated PDK-53, has several measurable biological markers associated with attenuation, including temperature sensitivity, small plaque size, decreased replication in mosquito C6136 cell culture, decreased replication in intact mosquitoes, loss of neurovirulence for suckling mice and decreased incidence of viremia in monkeys. Clinical trials of the candidate PDK-53 vaccine have demonstrated its safety and immunogenicity in humans. Furthermore, the PDK-53 vaccine induces dengue virus-specific T-cell memory responses in human vaccine recipients. Some embodiments herein describe an improvement on the DEN-2 PDK-53 used in chimeric constructs disclosed herein.

Immunogenic flavivirus chimeras having a dengue-2 virus backbone and at least one structural protein of another dengue virus serotype can be used for preparing the dengue virus chimeras and methods for producing the dengue virus chimeras are described. The immunogenic dengue virus chimeras are provided, alone or in combination, in a pharmaceutically acceptable carrier as immunogenic compositions to minimize, inhibit, or immunize individuals against infection by one or more serotypes, such as dengue virus serotypes DEN-1, DEN-2, DEN-3 and DEN-4, alone or in combination. When combined, the immunogenic dengue virus chimeras may be used as multivalent vaccines (e.g. bi-, tri- and tetravalent) to confer simultaneous protection against infection by more than one species or strain of flavivirus. In certain embodiments, the dengue virus chimeras are combined in an immunogenic composition useful as a bivalent, trivalent or tetravalent vaccine against the known dengue virus serotypes or confer immunity to other pathogenic flaviviruses by including nucleic acids encoding one or more proteins from a different flavivirus.

In some embodiments, avirulent, immunogenic dengue virus chimeras provided herein contain the nonstructural protein genes of the attenuated dengue-2 virus (e.g. PDK-53), or the equivalent thereof, and one or more of the structural protein genes or immunogenic portions thereof of the flavivirus against which immunogenicity is to be induced in a subject. For example, some embodiments concern a chimera having attenuated dengue-2 virus PDK-53 genome as the viral backbone, and one or more structural protein genes encoding capsid, premembrane/membrane, or envelope of the PDK-53 genome, or combinations thereof, replaced with one or more corresponding structural protein genes from DEN-1, DEN-3 or DEN-4 or other flavivirus to be protected against, such as a different flavivirus or a different dengue virus serotype. In accordance with these embodiments, a nucleic acid chimera disclosed herein can have functional properties of the attenuated dengue-2 virus and is avirulent, but expresses antigenic epitopes of the structural gene products of DEN-1, DEN-3 or DEN-4 in addition to other flaviviruses and is immunogenic (e.g. induces an immune response to the gene products in a subject). Then, these DNA constructs are used to transcribe RNA from an infectious clone, this RNA is introduced into Vero cells again producing a new progeny virus at P1. These new progeny viruses are distinguishable from PDK-53. (See e.g. P1-P10).

In another embodiment, a nucleic acid chimera can be a nucleic acid chimera having, but not limited to, a first nucleotide sequence encoding nonstructural proteins from an attenuated dengue-2 virus, and a second nucleotide sequence encoding a structural protein from dengue-4 virus alone or in combination with another flavivirus. In other embodiments, the attenuated dengue-2 virus can be vaccine strain PDK-53 having one or more mutated amino acids (see Examples). These additional mutations confer desirable traits of use as live, attenuated dengue-2 or as chimeric constructs described herein. Some embodiments include structural proteins of one or more of C, prM or E protein of a second dengue virus.

Other aspects include that chimeric viruses can include nucleotide and amino acid substitutions, deletions or insertions for example, in the control PDK-53 dengue-2 genome to reduce interference with immunogenicity responses to a targeted dengue virus serotype. These modifications can be made in structural and nonstructural proteins alone or in combination with the example modifications disclosed herein and can be generated by passaging the attenuated virus and obtaining an improved composition for inducing an immune response against one or more dengue virus serotypes.

Certain embodiments disclosed herein provide for method for making the chimeric viruses of this invention using recombinant techniques, by inserting the required substitutions into the appropriate backbone genome. Other embodiments herein concern passaging a confirmed (e.g. safe and effective) live, attenuated chimeric virus for additional improvements. In certain embodiments, a dengue-2 backbone used herein can include one or more mutations presented in Table 3. In other embodiments, a dengue-dengue chimera of the instant application can include one or more mutations as presented in Table 3. In yet other embodiments, a dengue-dengue chimera can include all of the mutations for each chimera as represented in Table 3 for Den-2/Den-1, Den-2/Den-3 or Den-2/Den-4. Pharmaceutical compositions that include a live, attenuated virus represented by the constructs of Table 3 are contemplated. For example, mono-, di-, tri- or tetravalent compositions are contemplated of use herein using chimeras and live, attenuated dengue-2 viruses as presented in Table 3.

In certain embodiments, a live, attenuated DEN-2 variant contemplated herein can be formulated into a pharmaceutical composition wherein the pharmaceutical composition can be administered alone or in combination with dengue-dengue chimeras or dengue-flavivirus chimeras. In certain embodiments, a bi-, tri or tetravalent compositions can be administered in a single application or in multiple applications to a subject.

Flavivirus Chimeras

Dengue virus types 1-4 (DEN-1 to DEN-4) are mosquito-borne flavivirus pathogens. The flavivirus genome contains a 5'-noncoding region (5'-NC), followed by a capsid protein (C) encoding region, followed by a premembrane/membrane protein (prM) encoding region, followed by an envelope protein (E) encoding region, followed by the region encoding the nonstructural proteins (NS1-NS2A-NS2B-NS3-NS4A-NS4B-NS5) and finally a 3' noncoding region (3'NC). The viral structural proteins are C, prM and E, and the nonstructural proteins are NS1-NS5. The structural and nonstructural proteins are translated as a single polyprotein and processed by cellular and viral proteases.

Flavivirus chimeras can be constructs formed by fusing non-structural protein genes from one type, or serotype, of dengue virus or virus species of the flaviviridae, with protein genes, for example, structural protein genes, from a different type, or serotype, of dengue virus or virus species of the flaviviridae. Alternatively, a flavivirus chimera of the invention is a construct formed by fusing non-structural protein genes from one type, or serotype, of dengue virus or virus species of the flaviviridae, with further nucleotide sequences that direct the synthesis of polypeptides or proteins selected from other dengue virus serotypes or other viruses of the flaviviridae.

In other embodiments, avirulent, immunogenic flavivirus chimeras provided herein contain the nonstructural protein genes of the attenuated dengue-2 virus, or the equivalent thereof, and one or more of the structural protein genes, or antigenic portions thereof, of the flavivirus against which immunogenicity is to be conferred. Suitable flaviviruses include, but are not limited to those listed in Table 1.

Other suitable dengue viruses for use in constructing the chimeras can be wild-type, virulent DEN-1 16007, DEN-2 16681, DEN-3 16562 and DEN-4 1036 and attenuated, vaccine-strain DEN-1 PDK-13, DEN-2 PDK-53, DEN-3 PMK-30/FRhL-3 and DEN-4 PDK-48. Genetic differences between the DEN-1, DEN-2, DEN-3 and DEN-4 wild type/attenuated virus pairs are contemplated along with changes in the amino acid sequences encoded by the viral genomes.

Sequence listings for DEN-2 PDK-53 correspond to the DEN-2 PDK-53-V variant, wherein genome nucleotide position 5270 is mutated from an A to a T and amino acid position 1725 of the polyprotein or amino acid position 250 of the NS3 protein contains a valine residue. The DEN-2 PDK-53 variant without this nucleotide mutation, DEN-2 PDK-53-E, differs from PDK-53-V only in this one position. DEN-2 PDK-53-E has an A at nucleotide position 5270 and a glutamate at polyprotein amino acid position 1725, NS3 protein amino acid position 250. It is understood that embodiments herein include modified PDK 53 that include one or more passages in a separate host cell (e.g. Vero cells, see Table 1) where desirable traits of use in vaccine compositions contemplated herein are generated.

In certain embodiments, designations of the chimeras can be based on the DEN-2 virus-specific infectious clone modified backbones and structural genes (prM-E or C-prM-E) insert of other dengue viruses or other flaviviruses. DEN-2 for the dengue-2 backbone, followed by the strain from which the structural genes are inserted. One DEN-2 backbone variant is reflected in the next letter after the number designation. One particular DEN-2 backbone variant from which the chimera was constructed is indicated by the following letter placed after a hyphen, parent 16681 (P), PDK-53-E (E), or PDK-53-V (V); the last letter indicates the C-prM-E structural genes from the parental (P) strain or its vaccine derivative (V) or the prM-E structural genes from the parental (P) or its vaccine derivative (V1). For example; DEN-2/1-VP denotes the chimera comprising the attenuated DEN-2 PDK-53V backbone comprising a valine at NS3-250 and the C-prM-E genes from wild-type DEN-1 16007; DEN-2/1-VV denotes the DEN-2 PDK-53V backbone with the vaccine strain of dengue-1, DEN-1 PDK-13; DEN-2/1-VP1 denotes the DEN-2 PDK-53V backbone and the prM-E genes from wild-type DEN-1 16007; DEN-2/3-VP1 denotes the DEN-2 PDK-53V backbone and the prM-E genes from wild-type DEN-3 16562; DEN-2/4VP1 denotes the DEN-2 PDK-53V backbone and the prM-E genes from wild-type DEN-4 1036. Other chimeras disclosed herein are indicated by the same manner.

In one embodiment, chimeras disclosed herein contain attenuated dengue-2 virus PDK-53 genome as the viral backbone, in which the structural protein genes encoding C, prM and E proteins of the PDK-53 genome, or combinations thereof, can be replaced with the corresponding structural protein genes from dengue-1, dengue-3 or dengue-4 virus and optionally, another flavivirus to be protected against, such as a different flavivirus or a different dengue virus strain.

In the nonstructural protein regions, a Gly-to-Asp (wild type-to-PDK-53) mutation was discovered at nonstructural protein NS1-53 (genome nucleotide position 2579); a Leu-to-Phe (wild type-to-PDK-53) mutation was discovered at nonstructural protein NS2A-181 (genome nucleotide position 4018); a Glu-to-Val (wild type-to-PDK-53) mutation was discovered at nonstructural protein NS3-250 (genome nucleotide position 5270); and a Gly-to-Ala mutation (wild type-to-PDK-53) was discovered at nonstructural protein NS4A-75 (genome nucleotide position 6599). The live, attenuated DEN-2 virus of the instant invention further includes mutations as presented in any chimera or live, attenuated dengue-2 virus of Table 3.

PDK-53 virus strain has a mixed genotype at genome nucleotide 5270. A significant portion (approximately 29%) of the virus population encodes the non-mutated NS3-250-Glu that is present in the wild type DEN-2 16681 virus rather than the NS3-250-Val mutation. As both genetic variants are avirulent, this mutation may not be necessary in an avirulent chimera.

Previously, it was discovered that avirulence of the attenuated PDK-53 virus strain can be attributed to mutations in the nucleotide sequence encoding nonstructural proteins and in the 5' noncoding region. For example, a single mutation at NS1-53, a double mutation at NS1-53 and at 5'NC-57, a double mutation at NS1-53 and at NS3-250 and a triple mutation at NS1-53, at 5'NC-57 and at NS3-250, result in attenuation of the DEN-2 virus. Therefore, the genome of any dengue-2 virus containing such non-conservative amino acid substitutions or nucleotide substitutions at these loci can be used as a base sequence for deriving the modified PDK-53 viruses disclosed herein. Another mutation in the stem of the stem/loop structure in the 5' noncoding region will provide additional avirulent phenotype stability, if desired. Mutations to this region disrupt potential secondary structures important for viral replication. A single mutation in this short (only 6 nucleotide residues in length) stem structure in both DEN and Venezuelan equine encephalitis viruses disrupts the formation of the hairpin structure. Further mutations in this stem structure decrease the possibility of reversion at this locus, while maintaining virus viability.

Mutations disclosed herein can be achieved by any method known in the art including, but not limited to, naturally-occurring or selected clones having additional features once passaged in a cell line of interest (e.g. Vero cells). It is understood by those skilled in the art that the virulence screening assays, as described herein and as are well known in the art, can be used to distinguish between virulent and avirulent backbone structures.

Construction of Flavivirus Chimeras

Flavivirus chimeras described herein can be produced by splicing one or more of the structural protein genes of the flavivirus against which immunity is desired into a PDK-53 dengue virus genome backbone, or other methods known in the art, using recombinant engineering to remove the corresponding PDK-53 gene and replace it with a dengue-1, dengue-3 or dengue-4 virus gene or other gene known in the art.

Alternatively, using the sequences provided in the sequence listing, the nucleic acid molecules encoding the flavivirus proteins may be synthesized using known nucleic acid synthesis techniques and inserted into an appropriate vector. Avirulent, immunogenic virus is therefore produced using recombinant engineering techniques known to those skilled in the art.

A target gene can be inserted into the backbone that encodes a flavivirus structural protein of interest for DEN-1, DEN-3, DEN-4 or other flavivirus. A flavivirus gene to be inserted can be a gene encoding a C protein, a PrM protein and/or an E protein. The sequence inserted into the dengue-2 backbone can encode both PrM and E structural proteins. The sequence inserted into the dengue-2 backbone can encode all or one of C, prM and E structural proteins.

Suitable chimeric viruses or nucleic acid chimeras containing nucleotide sequences encoding structural proteins of other flaviviruses or dengue virus serotypes can be evaluated for usefulness as vaccines by screening them for the foregoing phenotypic markers of attenuation that indicate avirulence and by screening them for immunogenicity. Antigenicity and immunogenicity can be evaluated using in vitro or in vivo reactivity with flavivirus antibodies or immunoreactive serum using routine screening procedures known to those skilled in the art.

Dengue Virus Vaccines

In certain embodiments, chimeric viruses and nucleic acid chimeras can provide live, attenuated viruses useful as immunogens or vaccines. Some embodiments include chimeras that exhibit high immunogenicity to dengue-4 virus while producing no dangerous pathogenic or lethal effects.

To reduce occurrence of DHF/DSS in subjects, a tetravalent vaccine is needed to provide simultaneous immunity for all four serotypes of the virus. A tetravalent vaccine is produced by combining a live, attenuated dengue-2 virus of the instant application with dengue-2/1, dengue-2/3, and dengue-2/4 chimeras described above in a suitable pharmaceutical carrier for administration as a multivalent vaccine.

The chimeric viruses or nucleic acid chimeras of this invention can include structural genes of either wild-type or live, attenuated virus in a virulent or an attenuated DEN-2 virus backbone. For example, the chimera may express the structural protein genes of wild-type DEN-4 1036 virus, its candidate vaccine derivative in either DEN-2 backgrounds.

Viruses used in the chimeras described herein can be grown using techniques known in the art. Virus plaque titrations are then performed and plaques counted in order to assess the viability and phenotypic characteristics of the growing cultures. Wild type viruses can be passaged through cultured cell lines to derive attenuated candidate starting materials.

Chimeric infectious clones can be constructed from the various dengue serotype clones available. The cloning of virus-specific cDNA fragments can also be accomplished, if desired. The cDNA fragments containing the structural protein or nonstructural protein genes are amplified by reverse transcriptase-polymerase chain reaction (RT-PCR) from dengue virus RNA with various primers. Amplified fragments are cloned into the cleavage sites of other intermediate clones. Intermediate, chimeric dengue virus clones are then sequenced to verify the accuracy of the inserted dengue virus-specific cDNA.

Full genome-length chimeric plasmids constructed by inserting the structural protein and/or nonstructural protein gene region of dengue serotype viruses into vectors are obtainable using recombinant techniques well known to those skilled in the art.

Nucleotide and Amino Acid Analysis

The NS1-53 mutation in the DEN-2 PDK-53 vaccine virus is significant for the attenuated phenotype of this virus, because the NS1-53-Gly of the DEN-2 16681 virus is conserved in nearly all flaviviruses, including the tick-borne viruses, sequenced to date. DEN-4 vaccine virus can also contain an amino acid mutation in the NS1 protein at position 253. This locus, which is a Gln-to-His mutation in DEN-4 PDK-48 vaccine virus, is Gln in all four wild serotypes of dengue virus. This Gln residue is unique to the dengue viruses within the flavivirus genus. The NS1 protein is a glycoprotein that is secreted from flavivirus-infected cells. It is present on the surface of the infected cell and NS1-specific antibodies are present in the serum of virus-infected individuals. Protection of animals immunized with NS1 protein or passively with NS1-specific antibody has been reported. The NS1 protein appears to participate in early viral RNA replication.

The mutations that occurred in the NS2A, NS2B, NS4A, and NS4B proteins of the DEN-1, -2, -3 and -4 attenuated strains are conservative in nature. The NS4A-75 and NS4A-95 mutations of DEN-2 and DEN-4 vaccine viruses, respectively, occurred at sites of amino acid conservation among dengue viruses, but not among flaviviruses in general.

The flaviviral NS3 protein possesses at least two recognized functions: the viral proteinase and RNA helicase/NTPase. The 698-aa long (DEN-2 virus) NS3 protein contains an amino-terminal serine protease domain (NS3-51-His, -75-Asp, -135-Ser catalytic triad) that is followed by sequence motifs for RNA helicase/NTPase functions (NS3-196-GAGKT-284-DEAH, -459-GRIGR). None of the mutations in the NS3 proteins of DEN-1, DEN-2, or DEN-3 virus occurred within a recognized motif. The NS3-510 Tyr-to-Phe mutation in DEN-1 PDK-13 virus was conservative. Since the wild-type DEN-2, -3 and -4 viruses contain Phe at this position, it is unlikely that the Tyr-to-Phe mutation plays a role in the attenuation of DEN-1 virus. The NS3-182 Glu-to-Lys mutation in DEN-1 PDK-13 virus occurred at a position that is conserved as Asp or Glu in most mosquito-borne flaviviruses and it may play some role in attenuation. This mutation was located 15 amino acid residues upstream of the GAGKT helicase motif. As noted in previous reports, the NS3-250-Glu in DEN-2 16681 virus is conserved in all mosquito-borne flaviviruses except for yellow fever virus.

Nucleic acid probes selectively hybridize with nucleic acid molecules encoding the DEN-1, DEN-3 and DEN-4 viruses or complementary sequences thereof. By "selective" or "selectively" is meant a sequence which does not hybridize with other nucleic acids to prevent adequate detection of the dengue virus. Therefore, in the design of hybridizing nucleic acids, selectivity will depend upon the other components present in a sample. The hybridizing nucleic acid should have at least 70% complementarity with the segment of the nucleic acid to which it hybridizes. As used herein to describe nucleic acids, the term "selectively hybridizes" excludes the occasional randomly hybridizing nucleic acids, and thus, has the same meaning as "specifically hybridizing." The selectively hybridizing nucleic acid of this invention can have at least 70%, 80%, 85%, 90%, 95%, 97%, 98%, and 99% complementarity with the segment of the sequence to which it hybridizes, preferably 85% or more.

Sequences, probes and primers which selectively hybridize to the encoding nucleic acid or the complementary, or opposite, strand of the nucleic acid are contemplated. Specific hybridization with nucleic acid can occur with minor modifications or substitutions in the nucleic acid, so long as functional species-specific hybridization capability is maintained. By "probe" is meant nucleic acid sequences that can be used as probes or primers for selective hybridization with complementary nucleic acid sequences for their detection or amplification, which probes can vary in length from about 5 to 100 nucleotides, or preferably from about 10 to 50 nucleotides, or most preferably about 18-24 nucleotides.

If used as primers, the composition preferably includes at least two nucleic acid molecules which hybridize to different regions of the target molecule so as to amplify a desired region. Depending on the length of the probe or primer, the target region can range between 70% complementary bases and full complementarity and still hybridize under stringent conditions. For example, for the purpose of detecting the presence of the dengue virus, the degree of complementarity between the hybridizing nucleic acid (probe or primer) and the sequence to which it hybridizes is at least enough to distinguish hybridization with a nucleic acid from other organisms.

Nucleic acid sequences encoding the DEN-4, DEN-3 or DEN-1 virus (e.g. structural elements) can be inserted into a vector, such as a plasmid, and recombinantly expressed in a living organism (e.g. into a dengue-2 backbone) to produce recombinant dengue virus peptides and/or polypeptides and/or viruses.

Nucleic Acid Detection Methods

A rapid genetic test that is diagnostic for each of the vaccine viruses described herein is provided by the current invention. This embodiment of the invention enhances analyses of viruses isolated from the serum of vaccinated humans who developed a viremia, as well as enhancing characterization of viremia in nonhuman primates immunized with the candidate vaccine viruses.

These sequences include a diagnostic TaqMan probe that serves to report the detection of the cDNA amplicon amplified from the viral genomic RNA template by using a reverse-transciptase/polymerase chain reaction (RT/PCR), as well as the forward and reverse amplimers that are designed to amplify the cDNA amplicon, as described below. In certain instances, one of the amplimers has been designed to contain a vaccine virus-specific mutation at the 3'-terminal end of the amplimer, which effectively makes the test even more specific for the vaccine strain because extension of the primer at the target site, and consequently amplification, will occur only if the viral RNA template contains that specific mutation.

Automated PCR-based nucleic acid sequence detection system can be used, or other known technology for nucleic acid detection. The TaqMan assay is a highly specific and sensitive assay that permits automated, real time visualization and quantitation of PCR-generated amplicons from a sample nucleic acid template. TaqMan can determine the presence or absence of a specific sequence. In this assay, a forward and a reverse primer are designed to anneal upstream and downstream of the target mutation site, respectively. A specific detector probe, which is designed to have a melting temperature of about 10.degree. C. higher than either of the amplimers and containing the vaccine virus-specific nucleotide mutation or its complement (depending on the strand of RT/PCR amplicon that is being detected), constitutes the third primer component of this assay.

A probe designed to specifically detect a mutated locus in one of the vaccine viral genomes will contain the vaccine-specific nucleotide in the middle of the probe. This probe will result in detectable fluorescence in the TaqMan assay if the viral RNA template is vaccine virus-specific. However, genomic RNA templates from wild-type DEN viruses will have decreased efficiency of probe hybridization because of the single nucleotide mismatch (in the case of the parental viruses DEN viruses) or possibly more than one mismatch (as may occur in other wild-type DEN viruses) and will not result in significant fluorescence. The DNA polymerase is more likely to displace a mismatched probe from the RT/PCR amplicon template than to cleave the mismatched probe to release the reporter dye (TaqMan Allelic Discrimination assay, Applied Biosystems).

One strategy for diagnostic genetic testing makes use of molecular beacons. The molecular beacon strategy also utilizes primers for RT/PCR amplification of amplicons, and detection of a specific sequence within the amplicon by a probe containing reporter and quencher dyes at the probe termini. In this assay, the probe forms a stem-loop structure. The molecular beacons assay employs quencher and reporter dyes that differ from those used in the TaqMan assay.

Pharmaceutical Compositions

Embodiments herein provide for administration of compositions to subjects in a biologically compatible form suitable for pharmaceutical administration in vivo. By "biologically compatible form suitable for administration in vivo" is meant a form of the active agent (e.g. pharmaceutical chemical, protein, gene, of the embodiments) to be administered in which any toxic effects are outweighed by the therapeutic effects of the active agent. Administration of a therapeutically active amount of the therapeutic compositions is defined as an amount effective, at dosages and for periods of time necessary to achieve the desired result. For example, a therapeutically active amount of a compound may vary according to factors such as the disease state, age, sex, and weight of the individual, and the ability of antibody to elicit a desired response in the individual. Dosage regima may be adjusted to provide the optimum therapeutic response.

In one embodiment, the compound (e.g. pharmaceutical chemical, protein, peptide etc. of the embodiments) may be administered in a convenient manner, for example, subcutaneous, intravenous, by oral administration, inhalation, intradermal, transdermal application, intravaginal application, topical application, intranasal or rectal administration. Depending on the route of administration, the active compound may be contained in a protective buffer (e.g. FTA, F127/trehalose/albumin). In one embodiment, a composition may be orally administered. In another embodiment, the composition may be administered intravenously. In one embodiment, the composition may be administered intranasally, such as inhalation. In yet another embodiment, the composition may be administered intradermally using a needle-free system (e.g. Pharmajet®) or other intradermal administration system.

A composition may be administered to a subject in an appropriate carrier or diluent, co-administered with enzyme inhibitors or in an appropriate carrier such as liposomes. The term "pharmaceutically acceptable carrier" as used herein is intended to include diluents such as saline and aqueous buffer solutions. It may be necessary to coat the compound with, or co-administer the compound with, a material to prevent its inactivation. The active agent may also be administered parenterally, or intraperitoneally. Dispersions can also be prepared in glycerol, liquid polyethylene glycols, and mixtures thereof and in oils. Under ordinary conditions of storage and use, these preparations may contain a preservative to prevent the growth of microorganisms or other stabilizing formulation (e.g. FTA).

Pharmaceutical compositions suitable for injectable use may be administered by means known in the art. For example, sterile aqueous solutions (where water soluble) or dispersions and sterile powders for the extemporaneous preparation of sterile injectable solutions or dispersion may be used. In all cases, the composition can be sterile and can be fluid to the extent that easy syringability exists. It might be stable under the conditions of manufacture and storage and may be preserved against the contaminating action of microorganisms such as bacteria and fungi. The pharmaceutically acceptable carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of microorganisms can be achieved by heating, exposing the agent to detergent, irradiation or adding various antibacterial or antifungal agents.

Sterile injectable solutions can be prepared by incorporating active compound (e.g. a compound that induces an immune response to one or more dengue virus serotypes) in the required amount in an appropriate solvent with one or a combination of ingredients enumerated above, as required, followed by filtered sterilization.

Upon formulation, solutions will be administered in a manner compatible with the dosage formulation and in such amount as is therapeutically effective. The formulations are easily administered in a variety of dosage forms, such as the type of injectable solutions described above. It is contemplated that compositions are especially suitable for intramuscular, subcutaneous, intradermal, intranasal and intraperitoneal administration. A particular ratio may be sought such as a 1:1, 1:2 or other ratio (e.g. PFUs of a given dengue virus serotype)

The active therapeutic agents may be formulated within a mixture predetermined ratios. Single dose or multiple doses can also be administered on an appropriate schedule for a given situation (e.g. prior to travel, outbreak of dengue fever).

In another embodiment, nasal solutions or sprays, aerosols or inhalants may be used to deliver the compound of interest. Additional formulations that are suitable for other modes of administration include suppositories and pessaries.

Certain formulations can include excipients, for example, pharmaceutical grades of mannitol, lactose, starch, magnesium stearate, sodium saccharine, cellulose, magnesium carbonate and the like.

A pharmaceutical composition may be prepared with carriers that protect active ingredients against rapid elimination from the body, such as time-release formulations or coatings. Such carriers include controlled release formulations, such as, but not limited to, microencapsulated delivery systems, and biodegradable, biocompatible polymers, such as ethylene vinyl acetate, polyanhydrides, polyglycolic acid, polyorthoesters, polylactic acid and others are known.

Pharmaceutical compositions are administered in an amount, and with a frequency, that is effective to inhibit or alleviate side effects of a transplant and/or to reduce or prevent rejection. The precise dosage and duration of treatment may be determined empirically using known testing protocols or by testing the compositions in model systems known in the art and extrapolating therefrom. Dosages may also vary with the severity of the condition. A pharmaceutical composition is generally formulated and administered to exert a therapeutically useful effect while minimizing undesirable side effects. In general, dose ranges from about $10^2$ to $10^6$ PFU can be administered initially and optionally, followed by a second administration within 30 days or up to 180 days later, as needed. In certain embodiments, a subject can receive dual administration of a mono, bi-, tri or tetravalent composition disclosed herein wherein the composition is a single composition mixture or has predetermined compositions of different dengue virus serotypes. In some embodiments, a DEN2/4 chimera can be present in higher concentrations than other dengue virus serotypes such as a live, attenuated dengue-1.

It will be apparent that, for any particular subject, specific dosage regimens may be adjusted over time according to the individual need.

In one embodiment, a composition disclosed herein can be administered to a subject subcutaneously or intradermally.

The pharmaceutical compositions containing live, attenuated dengue viruses may be administered to individuals, particularly humans, for example by subcutaneously, intramuscularly, intranasally, orally, topically, transdermally, parenterally, gastrointestinally, transbronchially and transalveolarly. Topical administration is accomplished via a topically applied cream, gel, rinse, etc. containing therapeutically effective amounts of inhibitors of serine proteases. Transdermal administration is accomplished by application of a cream, rinse, gel, etc. capable of allowing the inhibitors of serine proteases to penetrate the skin and enter the blood stream. In addition, osmotic pumps may be used for administration. The necessary dosage will vary with the particular condition being treated, method of administration and rate of clearance of the molecule from the body.

In certain embodiments of the methods of the present invention, the subject may be a mammal such as a human or a veterinary and/or a domesticated animal or livestock or wild animal.

Therapeutic Methods

In one embodiment of the present invention, methods provide for inducing an immune response to dengue virus serotype(s) using a mono, bi-, tri or tetravalent formulation of live, attenuated and/or chimeric viral constructs contemplated herein.

Embodiments of the present invention is further illustrated by the following non-limiting examples, which are not to be construed in any way as imposing limitations upon the scope thereof. On the contrary, it is to be clearly understood that resort may be had to various other embodiments, modifications, and equivalents thereof which, after reading the description herein, may suggest themselves to those skilled in the art without departing from the spirit of the present invention or the scope of the appended claims.

EXAMPLES

The following examples are included to demonstrate certain embodiments presented herein. It should be appreciated by those of skill in the art that the techniques disclosed in the Examples which follow represent techniques discovered to function well in the practices disclosed herein, and thus can be considered to constitute preferred modes for its practice. However, those of skill in the art should, in light of the present disclosure, appreciate that many changes can be made in particular embodiments which are disclosed and still obtain a like or similar result without departing from the spirit and scope herein.

Example 1

In some exemplary methods, compositions used to generate as referred to herein as "master virus seeds (MVS)" are disclosed. These compositions may be derived from one or more live, attenuated dengue viruses, such as DEN-1, DEN-2, DEN-3, and DEN-4. In certain methods, compositions may be derived from one or more live attenuated Dengue viruses that include but are not limited to, specific constructs disclosed herein referred to as DENVax-1, DENVax-2, DENVax-3, and DENVax-4. In other exemplary methods, strategies used to generate and characterize these compositions are provided. In yet other embodiments, tetravalent dengue virus formulations and genetic and phenotypic characterization of these formulations are provided.

Production and Analysis of Pre-Master DENVax Viruses

Certain procedures were performed to generate pre-master dengue virus seeds, such as serial amplification and purification of dengue viruses (e.g. DENVax). First, DENVax viruses were re-derived by transfection of viral RNA transcribed from the full-length recombinant DENVax cDNA into production-certified cells (e.g. Vero cells), resulting in P1 (passage 1) virus seed. The four P1 viruses from each of dengue-1 to dengue-4 were then amplified and plaque purified to obtain the candidate pre-master vaccine P7 seeds (see Table 1). Certain tests were performed to analyze passages of dengue viruses. For example, full-length genome sequencing demonstrated that all four of the P2 (passage 2) seed viruses were genetically identical to their homologous progenitor, research-derived, research-grade candidate vaccine virus. The original plaque phenotypes were also retained in the P2 viruses. Six plaque purified viruses (P3 A-F) were isolated for each serotype of dengue virus (e.g. DENVax1-4) from the P2 seeds, and each isolated plaque was directly plaque purified two more times. The third plaque purification (P5) of each virus was amplified twice (P6 A-F and P7 A-F) in Vero cells to produce the potential pre-master P7 DENVax seeds (Table 1).

TABLE 1

Example of a cGMP Rederivation of DENVax Viruses in WCB-Vero Cells

| Passage | Seed Production/Purification | Characterizations |
|---|---|---|
| P1 | Transfect WCB-Vero with transcribed viral RNAs | Plaque titrate |
| P2 | Amplify P1 virus | Full genome sequence |
| P3 | Pick 6 plaques (A-F)/serotype from P2 plaque assay | Plaque purification |
| P4 | Pick plaques A-F from P3 plaque assay | Plaque purification |
| P5 | Pick plaques A-F from P4 plaque assay | Plaque purification |
| P6 | Amplify P5 A-F plaques | Plaque titrate |
| P7 | Pre-master seeds: Amplify P6 A-F | Full genome sequence, TaqMAMA, Plaque phenotypes |
| P8* | MVS: Amplify selected P7 virus seed | Full genetic and phenotypic characterization |
| P9 | WVS: Amplify P8 Master Seed viruses | Full genome sequence, TaqMAMA |
| P10 | BVS: Amplify P9 Working Seed viruses | Full genome sequence, TaqMAMA |

*One optimal P7 seed (A, B, C, D, E, or F) was selected based on the genetic and plaque analysis to make P8 MVS Some tests were further performed to characterize P7 DENVax seeds, such as analysis of genome sequences and plaque phenotypes of the P7 seeds, and comparison with P2 seeds (Table 2). Plaque phenotypes of the P7 viruses were generally similar to those of the P2 seeds. In some exemplary experiments, virus titers were monitored. Virus titers reached over 6.0 log pfu/ml for most of the P7 seeds, except for 5 viruses. Genome sequencing of more than 60 candidate vaccine virus seeds after 10 or more serial passages in Vero cells identified no reversion event at NS1-53 and NS3-250 of the three major attenuation determinants of the DENV-2 PDK-53 genetic vector, suggesting that these 2 loci are quite stable in candidate vaccine virus seeds. All sequence chromatograms of the 24 candidate strains generated from both forward and reverse sequencing for these two sites were homogenous without any minor nucleotide populations evident at the NS1-53 and NS3-250 genetic loci. In contrast to the NS1 and NS3 sites, different levels of reversions at the 5'NCR-57 attenuation locus were identified from multiple serially passaged research grade vaccine viruses, suggesting this locus might not be as stable as NS1 and NS3 after multiple passages in cell culture. Therefore, a sensitive mismatch amplification assay (TaqMAMA) was developed to accurately measure the reversion rate at the 5'NCR-57 locus by real-time RT-PCR. In some studies, the 5'NCR-57 reversion rates of all 24 of the P7 seeds were measured by the TaqMAMA. Depending on the concentration of the input viral RNA for each virus in the assay, the sensitivity limit of the TaqMAMA ranged between 0.01% and 0.07% reversion, which is much more sensitive than the 10-30% reversion sensitivity limit detectable by consensus genome sequence analysis. The resulting data illustrates that 15 of the 24 P7 viruses had minimal or undetectable reversion (<0.07%), one virus (DENVax-3-D) had almost 100% reversion, and 8 viruses (1 DENVax-1, 1 DENVax-2, 2 DENVax-3, and 4 DENVax-4) had partial reversion ranging from 0.08% to 12.85% (Table 2). Full-length genome sequencing was conducted for 16 of the 24 P7 viruses with low levels of 5'NCR57 reversion as measured by TaqMAMA. All the sequenced viruses maintained the other two DENVax attenuation determinants (NS1-53, NS3-250), and all had acquired additional mutations that were not present in the original, engineered recombinant cDNA clones (Table 2). In one exemplary target vaccine composition, DENVax-1-A, DENVax-2-F, DENVax-3-F, and DENVax-4-F were selected as target pre-master seed for each serotype because their genotypes and plaque phenotypes most closely resembled those of the originally designed vaccine recombinants. The DENVax-1-A, DENVax-2-F, and DENVax-4-F had two non-synonymous mutations, and the DENVax-3-F had one. The evidence suggests these additional mutations observed in these 4 pre-master seeds do not cause safety concerns or immunogenicity alterations for the viruses. These pre-master seeds were further amplified to generate the MVS (master seed, designated as P7, Table 1).

Exemplary methods provided herein used purified in-vitro transcribed viral RNA from cloned cDNA plasmid as the pure source to transfect vaccine-certified Vero cells to generate vaccine virus. Serial plaque purifications and full-genome sequence analyses were incorporated into the manufacturing procedures to ensure manufactured vaccine seeds with optimal purity and genetic stability. Six cloned viruses were prepared as potential pre-master seeds for each serotype of DENVax. Through genomic analysis, including TaqMAMA and complete genomic sequencing, as well as characterization of viral plaque phenotypes, pre-master seeds were chosen to advance to master virus seeds production for each serotype (serotypes 1-4). The selected pre-master seeds had undetectable reversions (<0.01% or <0.07%) at the 5'NCR-57 locus, with 1 or 2 amino acid substitutions in their genomes, and retained the small plaque phenotypes previously observed.

TABLE 2

Characterizations of pre-master (P7) seeds

| Virus | Clone[a] | TaqMAMA[b] | Log$_{10}$ pfu/ml | Plaque[c] | Mutations identified in genome[d] |
|---|---|---|---|---|---|
| DENVax-1 | A | ** | 6.85 | P2 | NS2A-116 I-L, NS2B-92 E-D, one silent |
|  | B | * | 6.93 | P2 | nd[e] |
|  | C | * | 6.93 | D | nd |
|  | D | ** | 7.02 | D | C-67 K-A; one silent |
|  | E | 0.57% | 7.28 | P2 | nd |
|  | F | ** | 7.18 | P2 | E473 T-M; one silent |
| DENVax-2 | A | 0.03% | 6.33 | P2 | NS1-341 K-N |
|  | B | * | 6.33 | P2 | E-305 K-T, two silent |
|  | C | * | 5.84 | L | NS4A-18 T-A, four silent |
|  | D | 0.08% | 6.20 | P2 | NS2B-99 I-L, one 3'NCR |
|  | E | 0.03% | 6.31 | P2 | prM-52 K-E, NS5-412 I-V, two silent |
|  | F | ** | 6.15 | P2 | prM-52 K-E, NS5-412 I-V |
| DENVax-3 | A | * | 6.00 | P2 | NS5-200 K-N, one silent, one 3'NCR |
|  | B | 0.05% | 6.27 | P2 | NS2A-33 I-T, NS2A-59 M-T |
|  | C | 0.30% | 6.25 | P2 | nd |
|  | D | 100.00% | 6.27 | P2 | nd |
|  | E | 0.31% | 6.00 | P2 | nd |
|  | F | ** | 6.30 | P2 | E-223 T-S, one silent |
| DENVax-4 | A | 0.47% | 5.60 | P2 | E323 K-R/K, NS2B-21 L-F/L, NS2B-39 T-S, one silent |
|  | B | * | 5.65 | D | NS2A-126 A-V; NS4A-5 N-D; NS5-383 K-R, one silent |
|  | C | 4.50% | 5.90 | P2 | nd |
|  | D | 12.85% | 5.97 | D | nd |
|  | E | 0.52% | 6.85 | S | prM-85 E-D, NS2B-45 T-A, NS5-320 M-T, NS5-551 E-G, two silent |
|  | F | 0.02% | 6.93 | S | NS2A-66 D-G, NS4A-21 A-V, four silent |

[a]Cloned viruses (by serial plaque purifications) selected for further development of MVS are designated bold.
[b]* Reversion rate < 0.07% (detection limit).
** Reversion rate < 0.01% (detection limit)
[c]Plaque phenotypes: P2: similar to P2 virus; L = larger than P2 virus, D = similar size, but appear somewhat different in clearness of the plaques; S = smaller than P2.
[d]Substitutions differing from the engineered DENVax cDNA clones. Amino acid mutations are listed with residue position of the virus protein and the changes (wt-mutation). Total number of silent mutations in structural and non-structural genes of each seed is listed.
Mutations at non-coding region (NCR) are also noted.
[e]nd = Not done. These clones had higher 5'NCR-57 reversion rates (by TaqMAMA) than other clones, so were excluded from further sequence analysis.

Example 2

In some exemplary methods, compositions of master virus seeds, working virus seeds and bulk virus seeds as well as their genetic and phenotypic characterization are described. These compositions are provided for manufacture of clinical materials and ultimately commercial vaccine supplies. Serial plaque purifications and full-genome sequence analyses were incorporated into the manufacturing process to ensure compositions of vaccine seeds with optimal safety and genetic stability for manufacture of clinical trial materials.

Production and Manufacturing Quality Controls for MVS, WVS, and BVS

In some studies, MVS of the 4 DENVax were produced by amplifying the pre-master P7 seed in certified Vero cells. In other studies, MVS were used to make large amount of WVS in cell factories. Further, the BVS stocks of DENVax were amplified from the WVS and were formulated into tetravalent drug product mixtures to be used used for human clinic trials. Quality controls for product release were performed in some exemplary methods, including, but not limited to, testing all of the MVS, WVS, and BVS for identity, infectious titer, sterility, mycoplasma, and in vitro and in vivo adventitious agents. All seeds passed the virus identity test using serotype-specific RT-PCR assays, which showed positive amplification corresponding to its serotype and negative for heterologous serotypes (data not shown). No detectable mycoplasma or adventitious agents were detected in the MVS, WVS, or BVS stocks.

Genetic Analysis of the MVS, WVS, and BVS

In certain exemplary methods, after generation of MVS from the selected pre-MVS (P7) strains selected above were produced and the respective viral RNA was sequenced again. Full-length genome sequencing revealed that the MVS for DENVax-1 was identical to its pre-master seed, while the WVS and subsequent BVS acquired 2 additional substitutions at E-483 and NS4B-108 (see Tables 2 and 3). The Ala substitution at E-483 represented part of the genotype in the MVS, but became the dominant genotype in BVS. DENVax-2 and DENVax-3 were identical to their respective pre-master seeds (Table 2 and 3). The DENVax-2 MVS was identical to its pre-master seed, and the WVS and BVS had 2 additional mutations at NS4A-36 and NS4B-111. Both mutations were partial in WVS and were the major genotype in the BVS. The MVS of DENVax-3 was again identical to the pre-master seed, but the WVS and BVS contained an additional aa substitution at NS4A-23. The DENVax-4 MVS acquired an additional amino acid mutation, at locus NS2A-99 (from Lys to Lys/Arg mixed genotype) during production of the MVS (Table 3). Its WVS and BVS retained the NS2A-99 Lys/Arg mixed genotype, and the BVS had an extra NS4B-238 Ser/Phe mixed genotype. Consensus sequence results also confirmed that MVS, WVS as well as BV retained the three genetic determinants of attenuation at the 5'NCR-57, NS1-53, and NS3-250 loci. Analysis of the least stable attenuating locus by TaqMAMA demonstrated that the 5'NCR-57 reversion rate between <0.7% to and 0.13% among MVS, <0.07% among WVS, and between <0.07 and 0.21% among BVS. A 3% reversion at the 5'NCR-57 locus was considered the maximum permissible rate for acceptance of a vaccine lot (Table 3).

sensitive TaqMAMA of the 5'NCR-57 locus demonstrated minimal or undetectable reversion in the MVS, WVS (P9/Working), and BVS (Bulk Virus Seed for vaccines) of

TABLE 3

Nucleotide and amino acid substitutions in DENVax seeds

| DENVax | Nucleotides | Amino Acids | Pre-master | MVS[a] | WVS[a] | BVS[a] |
|---|---|---|---|---|---|---|
| DENVax-1 | 2384 G-C | E-483 Gly-Ala | — | — | Gly/Ala | Ala |
|  | 3823 A-C | NS2A-116 Ile-Leu | Leu | Leu | Leu | Leu |
|  | 4407 A-T | NS2B-92 Glu-Asp | Asp | Asp | Asp | Asp |
|  | 7148 C-T | NS4B-108 Thr-Ile | — | — | Ile | Ile |
|  | 7311 A-G | silent | G | G | G | G |
|  | TaqMAMA 5'NCR-57 reversion %[b] | — | — | — | — | — |
| DENVax-2 | 592 A-G | prM-52 Lys-Glu | Glu | Glu | Glu | Glu |
|  | 6481 G-C | NS4A-36 Ala-Pro | — | — | Ala/Pro | Pro |
|  | 7156 C-T | NS4B-111 Leu-Phe | — | — | Leu/Phe | Phe |
|  | 8803 A-G | NS5-412 Ile-Val | Val | Val | Val | Val |
|  | TaqMAMA 5'NCR-57 reversion %[b] | — | — | — | 0.07% | 0.21% |
| DENVax-3 | 1603 A-T | E-223 Thr-Ser | Ser | Ser | Ser | Ser |
|  | 6436 G-A | NS4A-23 Asp-Asn | — | — | Asn | Asn |
|  | 7620 A-G | silent | G | G | G | G |
|  | TaqMAMA 5'NCR-57 reversion %[b] | — | — | — | — | — |
| DENVax-4 | 225 A-T | silent | T | T | T | T |
|  | 3674 A-G | NS2A-66 Asp-Gly | Gly | Gly | Gly | Gly |
|  | 3773 A-A/G | NS2A-99 Lys-Lys/Arg | — | Lys/Arg | Lys/Arg | Lys/Arg |
|  | 5391 C-T | silent | T | T | T | T |
|  | 6437 C-T | NS4A-21 Ala-Val | Val | Val | Val | Val |
|  | 7026 T-C | silent | T/C | T/C | T/C | T/C |
|  | 7538 C-C/T | NS4B-238 Ser-Ser/Phe | — | — | Ser/Phe | Ser/Phe |
|  | 9750 A-C | silent | C | C | C | C |
|  | TaqMAMA 5'NCR-57 reversion %[b] | — | 0.13% | — | — |

[a]Bold: Changes started at MVS stocks.
[b]"—" indicates reversion rate <0.01% (detection limit), "—" indicates reversion rate <0.07% (detection limit)

Full-genome sequence analysis revealed that an additional amino acid mutation developed in the DENVax-4 MVS, while the other three DENVax MVS lots retained the consensus genome sequence of their pre-master seeds. Overall, from deriving of the P1 seeds to the pre-master (P7) seeds, only 1 or 2 non-synonymous mutations occurred in a given seed. From P1 to MVS (P8) seeds, 2 to 7 nucleotide substitutions were identified in any given DENVax seed and only 2 to 3 of these substitutions resulted in amino acid changes. Thus, minor changes occurred. RNA viruses are error-prone in their genome replication, so genetic substitutions in flavivirus genome during cell passages are not unexpected. None of the silent mutations in the MVS were within the 5' or 3'NCR that may affect virus replication. Only the change in prM-52 Lys-Glu of the DENVax-2, and the substitution in NS2A-66 Asp-Gly of DENVax-4 are not conservative changes. The NS2A-66 mutation of the DENVax-4 is in the nonstructural backbone part of the DENV-2 PDK-53. Although NS2A-66 locus is usually Asp among various strains of DENV-2, it is usually Gly for DENV-4. It is possible that the Asp to Gly change in the DENVax-4 is relevant for fitness of the DENVax-4 in Vero cells. The DENVax-2 prM-52 mutation resides in the C-terminal portion of the prM that is cleaved out from the mature virus particles. In some exemplary methods, phenotypic characterization was performed to confirm that none of the mutations in the MVS seeds significantly altered the attenuation phenotypes of the vaccine.

The DENVax viruses demonstrated high genetic stability during the manufacturing process. The three defined DENV-2 PDK-53 attenuation loci located in 5'NCR, NS1-53, and NS3-250 remained stable in the consensus genome sequence upon serial passage of the DENVax from pre-Master strains to bulk vaccine preparations. The highly sensitive TaqMAMA of the 5'NCR-57 locus demonstrated minimal or undetectable reversion in the MVS, WVS (P9/Working), and BVS (Bulk Virus Seed for vaccines) of dengue virus serotypes. The 5'NCR-57 reversion rates of the DENVax BVS preparations (P10-equivalent) were significantly lower than the 5'NCR-57 reversion rates that evolved in research-grade vaccine candidates after 10-serial passages in Vero cells (4-74% reversion). The strategy for large-scale manufacturing of the DENVax seeds provided herein resulted in a genetically stable vaccine seed which retained the attenuation markers in the candidate vaccine viruses.

Plaque Phenotype of DENVax MVS

Figure 2:
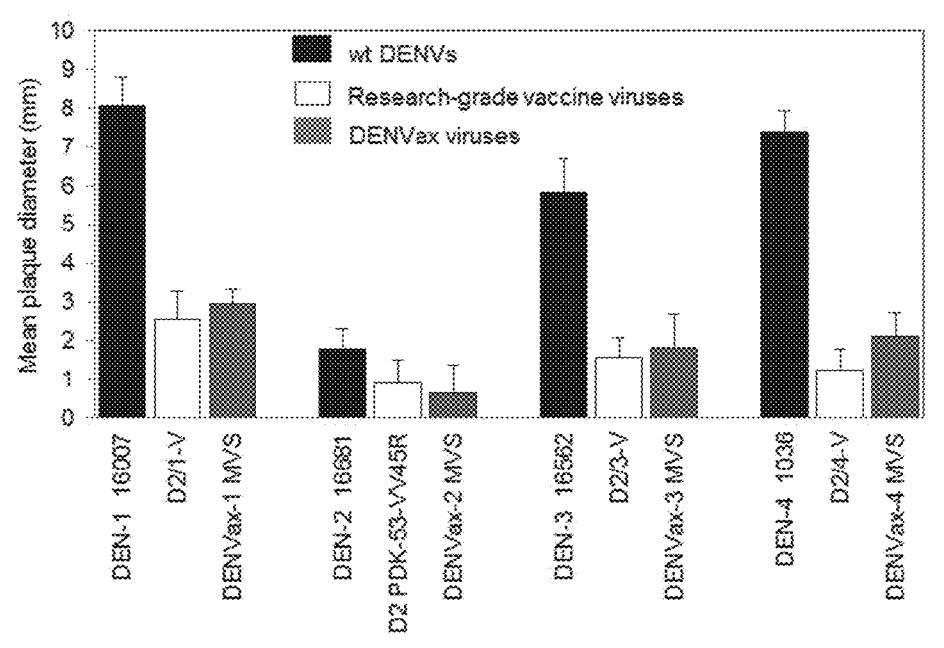

In one exemplary method, plaque phenotypes of the DENVax MVS were compared with wild type Dengue viruses and their homologous research-grade chimeric viruses in Vero cells (FIG. 2). All of the MVS of DENVax-1, -2, and -3 produced plaques that were significantly smaller than their wild type homologs and very similar (within 0.4-mm differences) to their homologous research-grade viruses in Vero cells. DENVax-4 MVS was also significantly smaller than the wild type DENV-4, but was slightly larger (0.9 mm difference) than the original lab derived D2/4-V chimera.

FIG. 2 represents an exemplary histogram illustrating plaque sizes of the DENVax MVS in contrast with control wild type viruses and research-grade vaccine candidate viruses. Mean plaque diameters (mm)±SD (error bars) of the virus plaques in Vero cells under agarose overlay measured on day 9 pi. The wild type DEN viruses, represented by black bars, and previously published research-grade vaccine candidate viruses, represented by white bars, were included for control and comparison to the DENVax master vaccine seeds represented by grey bars.

Temperature Sensitivity of DENVax MVS

In another exemplary method, temperature sensitivity was tested in Vero cells for the DENVax MVS and compared with their homologous wild type and the original research-grade chimeric vaccine virus. The wild type (wt) DENV-3 16562 was not temperature sensitive. The wt dengue virus serotype 1 and dengue virus serotype-4 were moderately temperature sensitive at 39° C. (titers were approximately 1.0 $\log_{10}$ pfu/ml lower at 39° C. than at 37° C., FIG. 3). Wt Dengue virus serotype-2 16681 was the most temperature sensitive of the wt Dengue viruses tested, and resulted in a 100-fold titer drop at 39° C. DENVax-1, -2, and -3 were as temperature sensitive as their original homologous research-grade chimeric vaccine viruses (FIG. 2). Titers at 39° C. dropped between 2.0 and 3.0 $\log_{10}$ pfu/ml for these DENVax strains. DENVax-4 also was temperature sensitive, demonstrating a 5-fold reduction in titer. However, the original research-grade D2/4-V demonstrated about a 10-fold reduction in titer. The final stabilized DENVax-4 MVS contained F127 (and other agents known to stabilize these formulations (FTA)), which was shown to enhance thermal stability of the Dengue viruses. The presence of the F127 in DENVax-4 MVS likely contributed to the less pronounced temperature sensitivity of the virus in the Vero culture assay. In a separate experiment, temperature sensitivity of an MSV-derived DENVax-4 strain in the absence of F127 was further evaluated. To remove the F127 from the strain, viral RNA was isolated from a DENVax-4 bulk virus preparation and was transfected into Vero cells. This DENVax-4 virus appeared to be as temperature sensitive as the D2/4 V research strain (titer reduced 1.5 $\log_{10}$ pfu/ml) on day 3 pi in the absence of F127 (FIG. 3).

Figure 3:
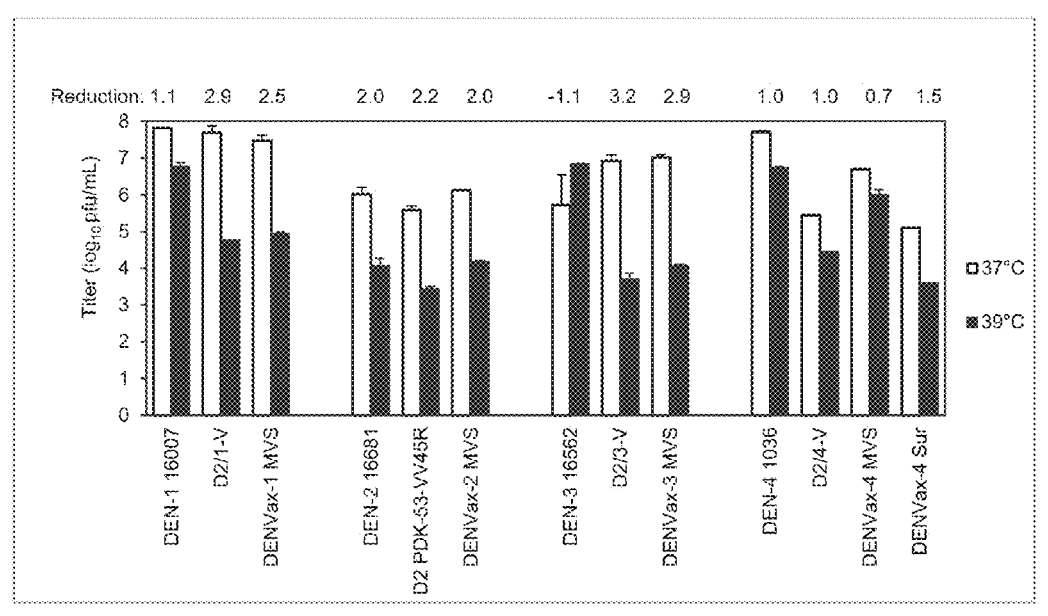

FIG. 3 illustrates an exemplary histogram illustrating temperature sensitivities of DENVax MVS. The wild type Dengue viruses and previously published research-grade vaccine candidate viruses were included for comparison. The DENVax-4 MVS contains additional F-127 that can mask the temperature sensitivity results of the virus in this assay. A separate experiment analyzing a surrogate DENVax-4 in the absence of F127 was also included. Mean titers±SD (error bars) of the viruses replicated in Vero cells at 37° C. or 39° C.

DENVax MVS Replication in Mosquito C6/36 Cells

In some exemplary methods, the DENVax MVS were grown in C6/36 cells to verify their retention of the in vitro attenuation phenotype, with the knowledge that the research-grade chimeric vaccine viruses retained the attenuation phenotype of the backbone DENV-2 PDK53 virus in these mosquito cells. Compared to the wt Dengue viruses, DENVax-1, DENVax-2 and DENVax-4 MVS showed significant growth reduction (at least 3 $\log_{10}$ pfu/ml reduction) in C6/36 cells on day 6 pi (FIG. 4). The DENVax-3 MSV also exhibited reduced growth compared to the wt DENV-3 16562, but the reduction was not as marked (1-2 $\log_{10}$ pfu/ml reduction). However, the C6/36 titers of the DENVax-3 seed lots were similar (within 1 $\log_{10}$ pfu/ml difference) to the C6/36 titer of the original research-grade chimeric D2/3-V vaccine virus.

FIG. 4 illustrates an exemplary histogram plotting restricted growth of DENVax MVS (grey bars) in C6/36 cells in comparison with wt Dengue viruses (black bars) and research-grade vaccine viruses (white bars). Mean titers±SD (error bars) of the viruses replicated in C6/36 cells 6 days pi.

Virus Infection, Dissemination, and Transmission Rates in Whole Mosquitoes

In some exemplary methods, the infection and dissemination rates of the DENVax were compared with their parental wt Dengue viruses. In certain exemplary experiments, oral infection experiments were conducted in *Ae. aegypti* mosquitoes. Infectious blood meals were back-titrated to measure the virus titers and only the experiments with similar virus titers in the blood meal (less than 1 $\log_{10}$ pfu/ml differences) between parental Dengue viruses and DENVax for each serotype were included for comparisons in Table 4. DENVax-1, DENVax-2, and research-grade D2 PDK-53-VV45R did not infect mosquitoes through oral feeding, which is significantly different (p<0.0001) from their parental viruses, DENV-1 16007 (44% infection) and DENV-2 16681 (43.3% infection). Because no mosquito was infected by DENVax-1 and -2, there was little to no dissemination concern for these two vaccine viruses. While DENVax-4 did infect some mosquitoes through oral feeding (2 out of 55), the infection rate was significantly lower (p<0.05) than its parental wt virus, DENV-4 1036 (8 out of 50). DENVax-3 did not infect any mosquitoes in two experiments with blood meal viral titers of 5.2±0.02 $\log_{10}$ pfu/ml (Table 4), and in a separate experiment with blood meal viral titer of 6.0 $\log_{10}$ pfu/ml, only 1 out of 30 mosquitoes became infected (data not shown). However, wt Dengue virus-3 16562 also had a very low infection rate (8%) at 5.2 $\log_{10}$ pfu/ml, and the rate did not increase in a separate experiment with a higher blood meal viral titer at 6.2 $\log_{10}$ pfu/ml (3%, 1 positive out of 30 mosquitoes, data not shown). Although the wild type (wt) Dengue virus-3 and Dengue virus-4 had significantly lower infection rates than the wt Dengue virus-1 and Dengue virus-2, the mean virus titers in the infected mosquitoes were similar (3.1 to 3.9 $\log_{10}$ pfu/mosquito). In contrast, the DENVax-4 titers from the two infected mosquitoes were both minimal (0.7 $\log_{10}$ pfu/mosquito), which was 1,000-fold lower than the titer from the mosquitoes infected by wt Dengue virus serotype-4 1036 (3.9±1.5 pfu/mosquito).

For those mosquitoes that were infected, dissemination out of the midgut could be assessed by determining whether virus was present in the legs. The four parental DENVs resulted in dissemination rates ranging between 36.3% and 62.5%, and their mean virus titers (in $\log_{10}$ pfu) from the legs were between 0.9±0.3 and 2.2±0.7 (excluding negative samples). Neither of the two DENVax-4 infected mosquitoes resulted in virus dissemination to the legs (Table 4). While disseminated virus was detectable in the legs, none of the four wt Dengue viruses was detectable in saliva of orally infected mosquitoes, suggesting that oral feeding conditions may not be sufficiently sensitive to measure the transmission rate of these DENVs. Therefore, in other exemplary methods, highly stringent artificial mosquito infections by direct IT inoculation were subsequently performed (Table 4). Except for DENVax-4, all viruses (wt and DENVax) achieved 100% infection of the IT inoculated *Ae. aegypti*. The DENVax-4 inoculum had a slightly lower viral titer than the other three viral inocula, but it still successfully infected 70% of the inoculated mosquitoes. Despite the high body infection rates achieved by IT inoculation, all four DENVax viruses exhibited significantly lower (p<0.005) or non-detectable transmission rates (0-10%) compared to the wt Dengue viruses (43-87%, Table 4). The DENVax viruses demonstrated little to no infection and dissemination after oral feeding, and the highly stringent IT results affirmed the minimal transmission capacity of these DENVax viruses in *Ae. aegypti*.

TABLE 4

Virus infection, dissemination, and transmission rates in whole mosquitoes

| | Oral Feed | | | | | IT inoculation | | | | |
|---|---|---|---|---|---|---|---|---|---|---|
| Virus | Blood Meal[a] Mean ± SD | Infection[b] % (P/N) | Body Titer[c] Mean ± SD | $p^d$ | Dissemination[e] % (P/N)[f] | Inoculum pfu/dose | Infection[b] % (P/N) | Body Titer[c] Mean ± SD | Saliva[f] % (P/N) | $p^d$ |
| DENV-1 16007 | 6.6 | 44.0% (11/25) | 3.6 ± 1.5 | | 36.3% (4/11) | 53.9 | 100% (30/30) | 4.7 ± 0.48 | 43% (13/30) | |
| DENVax-1 | 6.9 | 0% (0/30) | NA | <0.0001 | NA | 67.8 | 100% (30/30) | 3.4 ± 0.39 | 10% (3/30) | <0.005 |
| DENV-2 16681 | 6.6 | 43.3% (13/30) | 3.1 ± 1.5 | | 38.5% (5/13) | 67.8 | 100% (30/30) | 5.2 ± 0.34 | 87% (26/30) | |
| D2 PDK53-VV45R | 6.4 | 0% (0/30) | NA | <0.0001 | NA | 56.4 | 100% (30/30) | 4.0 ± 0.20 | 0% (0/30) | <0.0001 |
| DENVax-2 | 6.4 | 0% (0/30) | NA | <0.0001 | NA | 52.7 | 100% (30/30) | 3.5 ± 0.27 | 7% (2/30) | <0.0001 |
| DENV-3 16562 | 5.2 | 8% (2/25) | 3.8 ± 0.2 | | 50% (1/23) | 34.0 | 100% (30/30) | 4.2 ± 0.50 | 67% (20/30) | |
| DENVax-3 | 5.2 ± 0.02 | 0% (0/50) | NA | 0.108 | NA | 37.3 | 100% (30/30) | 3.3 ± 0.36 | 3% (1/30) | <0.0001 |
| DENV-4 1036 | 5.8 ± 0.5 | 16% (8/50) | 3.9 ± 1.5 | | 62.5% (5/8) | 69.4 | 100% (30/30) | 5.2 ± 0.45 | 70% (21/30) | |
| DENVax-4 | 5.4 ± 0.4 | 3.6% (2/55) | 0.7 ± 0.0 | 0.033 | 0% (0/2) | 11.8 | 70% (21/30) | 1.1 ± 0.46 | 0% (0/21) | <0.0001 |

[a]Virus titers or Mean ± standard deviation if from more than 1 experiment in blood meal ($\log_{10}$ pfu/ml) by back titration
[b]Rate of virus detected in mosquito bodies. P/N = positive/total mosquitoes
[c]Mean virus titers ± standard deviation ($\log_{10}$ pfu/mosquito) in mosquito body, only positive sample are included for calculation
[d]Statistic analysis of the differences between wt DENV and DENVax by Fisher Exact probability
[e]Rate of virus detected in legs of the positively infected mosquitoes
[f]Rate of virus detected in saliva of the positively infected mosquitoes. Used to measure transmission efficiency Vector competence is an important safety component for live-attenuated flavivirus vaccine viruses. Previously, the research-grade DENV-2 PDK-53-VV45R virus and wt derivatives were tested in Ae. aegypti, and found that the NS1-53-Asp attenuating mutation was the dominant determinant for impaired mosquito replication. The other two major attenuation loci of the DENV-2 PDK-53 vaccine, nucleotide 5'NCR-57-T and NS3-250-Val, also exhibited some inhibiting effect on replication in mosquitoes, thus providing additional, redundant restrictions for mosquito vector competence. Some exemplary methods described herein were used to test the mosquito oral and IT infection and replication for all four DENVax strains. DENVax-1, -2, and -3 did not infect any Ae. aegypti mosquitoes through oral infection (Table 4). The DENVax-4 infected only 3.6% of orally exposed mosquitoes, a level significantly lower than that of the wt DENV-4 with a replicative mean titer in the mosquito bodies lower than that of wt DENV-4 infected mosquitoes. Surprisingly, DENVax-4 was detected in the legs of the infected mosquitoes, suggesting that DENVax-4 was not able to disseminate from the mosquito midgut following oral infection. The infection rates for the DENVax-1, -2, and -4 were all significantly less than their wt counterparts, but the difference was not significant between DENVax-3 and wt DENV-3 16562 due to the very low infection rates for both viruses. Compared to other wt strains of DENV assessed in Ae. aegypti collected from the same Mae Sot Province, Thailand, the parental wt Dengue virus strains used for engineering DENVax appeared to have lower infectious and dissemination rates by oral infection. The wt DENV-1 PUO359, DENV-2 PUO218, DENV-3 PaH881/88, and DENV-4 1288 used for engineering the Yellow Fever (YF) 17D vaccine-based ChimeriVax-DEN vaccines had infection rates ranging 47-77%. In contrast, the YF 17D vaccine cannot infect Ae. aegypti. Although the ChimeriVax strains contained the prM-E from these highly infectious wt DENV, the ChimeriVax retain the mosquito attenuation phenotype of their YF 17D replicative backbone. Results provided herein also indicated that the mosquito attenuation of DENV-2 PDK-53 backbone was maintained in the DENVax strains. In addition, using the wt Dengue virus strains with lower mosquito-infectivity in constructs included in compositions described herein provides an additional safety feature.

The oral infection results illustrate that the DENVax had minimum mosquito infectivity and dissemination capacity. In addition, the more sensitive and stringent IT infection experiments were performed to further analyze the potential of DENVax to be transmitted by Ae. aegypti. The IT results demonstrated that all four DENVax viruses had non-detectable or minimal mosquito transmission potential compared to their wt counterparts. DENVax transmission could only theoretically occur if (1) vector feeds on a vaccinee with a sufficient viremia titer to infect mosquito midgut, (2) the virus is capable of replicating in the midgut epithelium and able to subsequently disseminate out of the midgut, and (3) the disseminated virus can replicate in salivary gland and expectorate sufficient virus in saliva for transmission. The threshold of human viremia required to infect mosquitoes has not been established adequately, but human viremia can be $10^6$-$10^8$ mosquito infectious dose$_{50}$ (MID$_{50}$)/ml after natural wt DENV infection. This MID$_{50}$ was based on direct IT inoculation of mosquitoes with diluted human plasma. Analysis of DENVax in nonhuman primates indicated that viremia titers following DENVax immunization were very low (less than 2.4 $\log_{10}$ pfu/ml) and lasted for 2-7 days. Given the low viremia levels and the low mosquito infection, dissemination, and transmission capacity of DENVax, it is unlikely that these vaccine viruses could be transmitted by mosquitoes in nature or cause viremia.

Therefore, it is proposed that any of the passages of any of the serotypes (P1-P10) could be used in a composition to generate a safe and effective vaccine against one, two, three or all four dengue virus serotypes.

Neurovirulence in Suckling Mice

Figure 5:
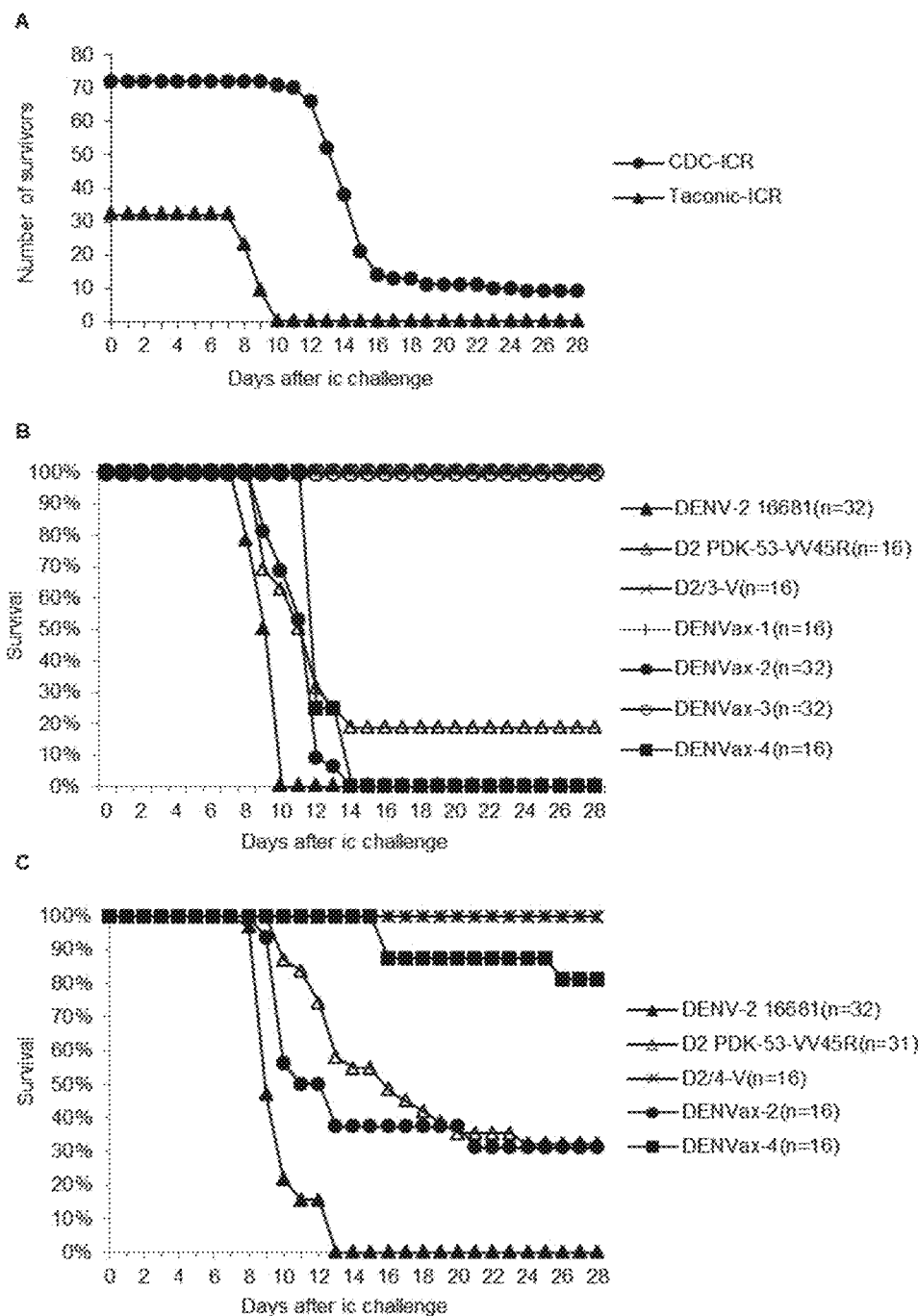
FIGS. 5A-5C represent exemplary plots of neurovirulence in newborn mice. Pooled results of several experiments summarizing the neurovirulence of wt DENV-2 16681 virus in CDC-ICR (n=72) and Taconic-ICR (n=32) newborn mice challenged is with $10^4$ pfu of the virus (A). Neurovirulence of DENVax MVS tested in Taconic-ICR mice with a dose of $10^4$ pfu (B) or $10^3$ pfu (C). The numbers of animals tested per group in one experiment (n=16) or two pooled experiments (n=31 or 32) are indicated.

The original research-grade vaccine viruses were highly attenuated for neurovirulence in newborn ICR mice maintained in-house at DVBD/CDC. All of these mice survived is (intracerebral) challenge with $10^4$ pfu of each vaccine virus. The wt Dengue virus serotype-2 16681 virus, on the other hand, resulted in 62.5%-100% mortality in these CDC-ICR mice in various experiments. In some experiments, commercial ICR mice obtained from Taconic Labs (Taconic-ICR) were used to study neurovirulence in newborn mice. It was observed that newborn Taconic-ICR mice were significantly more susceptible to Dengue virus serotype-2 infection than the previous CDC-ICR mice. FIG. 5A summarizes the neurovirulence of wt Dengue virus serotype-2 16681 in CDC-ICR colony and Taconic-ICR newborn mice challenged ic with $10^4$ pfu of the virus. The Taconic-ICR mice (100% mortality in 32 mice, average survival time of 8.3±0.5 days) were more susceptible to ic Dengue virus serotype-2 16681 challenge than the previous CDC-ICR mice (91% fatalities in 72 mice, average survival time of 14.6±2.3 days).

In other exemplary methods, in order to evaluate neurovirulence of the DENVax MVS, the Taconic-ICR mice initially were challenged ic (intracerebrally) with a dose of approximately $10^4$ pfu of wt Dengue virus serotype-2 16681, D2 PDK-53 VV45R, D2/3-V, or DENVax 1-4 virus in one (n=16) or two (n=31-32) experiments (FIG. 5B). At this dose, D2/3-V research grade virus, as well as DENVax-1, and DENVax-3 MVS exhibited fully attenuated neurovirulence phenotypes (no illness or mortality). As expected, wt Dengue virus serotype-2 was found to be "fatal", with average mouse survival time (AST) of 8.3±0.8 days. In these Dengue virus serotype-2-sensitive Taconic-ICR mice, the D2 PDK-53-VV45R research grade virus resulted in 81.3% mortality. The DENVax-2 MVS and DENVax-4 MVS were uniformly fatal in the Taconic-ICR, showing AST values of 9.8±1.7, 10.2±1.4, and 11.3±0.4 days, respectively.

In some exemplary methods, the neurovirulence of wt Dengue virus serotype-2 16681 virus was compared with that of D2 PDK-53 VV45R, DENVax-2 MVS and DENVax-4 MVS, as well as D2/4-V research grade virus, at a 10-fold lower dose ($10^3$ pfu, FIG. 5C). The wt Dengue virus serotype-2 retained a uniformly fatal neurovirulent phenotype, with AST of 9.0±1.4 days, at this lower challenge dose. The other 4 viruses exhibited intermediate neurovirulence phenotypes, and the degree of neurovirulence was serotype-specific. The D2 PDK-53-VV45R virus and its DENVax-2 MVS cognate showed significant attenuation (32.3% survival with AST of 13.1±3.8 days and 31.2% survival with AST of 10.5±3.4 days, respectively). Both the DENVax-4 MVS and the research grade D2/4-V virus were highly attenuated for neurovirulence (81.3% survival with AST of 18.8±5.8 days and 100% survival, respectively). The results suggested that MVS of DENVax-1 and -3 exhibited complete attenuation of neurovirulence, while DENVax-2 and -4 MVS lots retained attenuation phenotypes that closely resembled their homologous research-grade virus vaccine candidates.

FIGS. 5A-5C represent exemplary graphs illustrating neurovirulence in newborn mice tested with various compositions including wt Dengue virus serotype-2 and different attenuated Dengue viruses. Pooled results of numerous experiments summarizing the neurovirulence of wt Dengue virus serotype-2 16681 virus in CDC-ICR (n=72) and Taconic-ICR (n=32) newborn mice challenged is with $10^4$ pfu of the virus (A). Neurovirulence of DENVax MVS tested in Taconic-ICR mice with a dose of $10^4$ pfu (B) or $10^3$ pfu (C). The numbers of animals tested per group in one experiment (n=16) or two pooled experiments (n=31 or 32) are indicated.

Plaque Phenotype of WVS, and BVS

Figure 6:
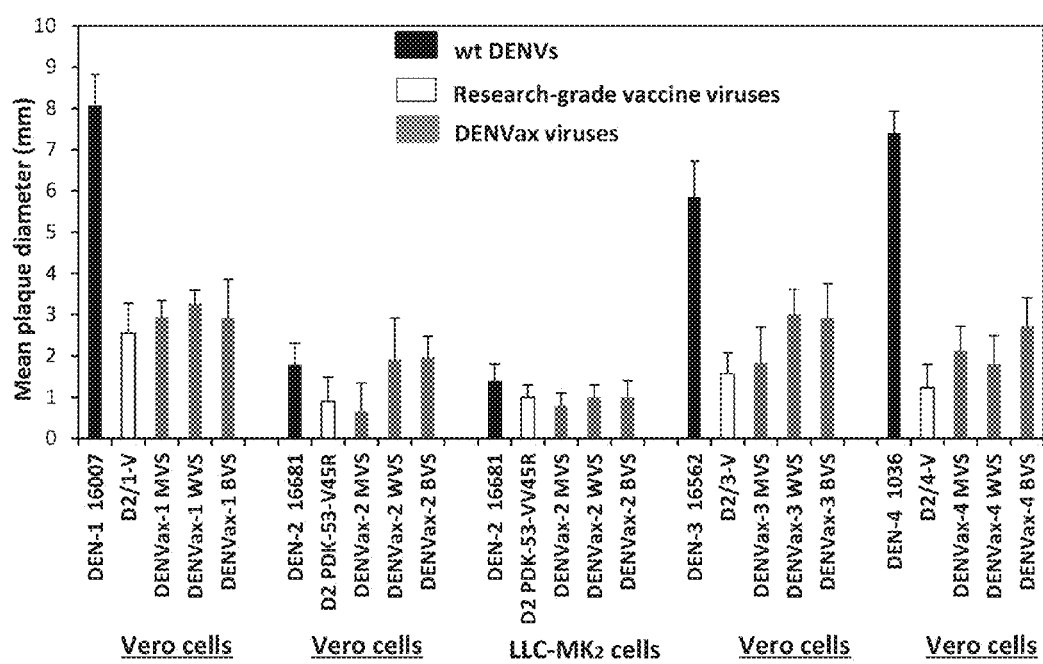
FIG. 6 represents an exemplary histogram illustrating plaque size of the DENVax MVS, WVS, and BVS. Mean plaque diameters±SD (error bars) of the virus plaques in Vero or LLC-MK$_2$ cells under agarose overlay measured on day 9 pi. Wild type DENVs and previously published research-grade vaccine candidate viruses were included for control and comparison.

Certain studies were performed to compare plaque phenotypes of WVS and BVS with MVS, wt Dengue viruses and their homologous lab derived, research-grade chimeras in Vero cells (FIG. 6). Mean plaque sizes were calculated from 10 plaques for each vaccine virus, but from reduced numbers of wt DENV-1, -3, and -4. All of the MVS viruses of DENVax-1, -2, and -3 produced plaques that were significantly smaller than their wt homologs and very similar (within 0.4-mm differences) to their homologous research-grade viruses in Vero cells. DENVax-4 MVS was also significantly smaller than the wt DENV-4, but was slightly (0.9 mm) larger than the original lab derived D2/4-V chimera. With the exception of the DENVax-2, all of the WVS and BVS of the DENVax-1, -3, -4 retained significantly smaller plaque sizes than those produced from their wt homologs. The DENVax-2 WVS and BVS produced plaques that were similar to the plaques of wt DENV-2 virus in Vero cells, but when tested in LLC-MK$_2$ cells all of the DENVax-2 manufactured seeds produced plaques that were somewhat smaller than those of the wt DENV-2 (1.4±0.4) and similar to the lab derived D2 PDK-53-VV45R (1.0±0.3) (FIG. 6).

Evaluation of the phenotypic markers of viral attenuation, including small plaque phenotype, temperature sensitivity, reduced replication in mosquito cells, reduced infection/dissemination/transmission by mosquitoes, and reduced neurovirulence in newborn ICR mice, were assessed for the compositions of MVS stocks. Results indicated that all of the DENVax retained the expected attenuation phenotypes similar to the original research-grade vaccine viruses. Given the mutations responsible for attenuation are conserved in all MVS, WVS and BV, it can be expected the attenuated phenotypes to be retained in the material manufactured for human clinical testing.

FIG. 6 represents an exemplary histogram illustrating plaque size of the DENVax MVS, WVS, and BVS. Mean plaque diameters±SD (error bars) of the virus plaques in Vero or LLC-MK$_2$ cells under agarose overlay measured on day 9 pi. The wt DENVs and previously published research-grade vaccine candidate viruses were included for control and comparison.

Virus Replication in Mosquito C6/36 Cells

Figure 7:
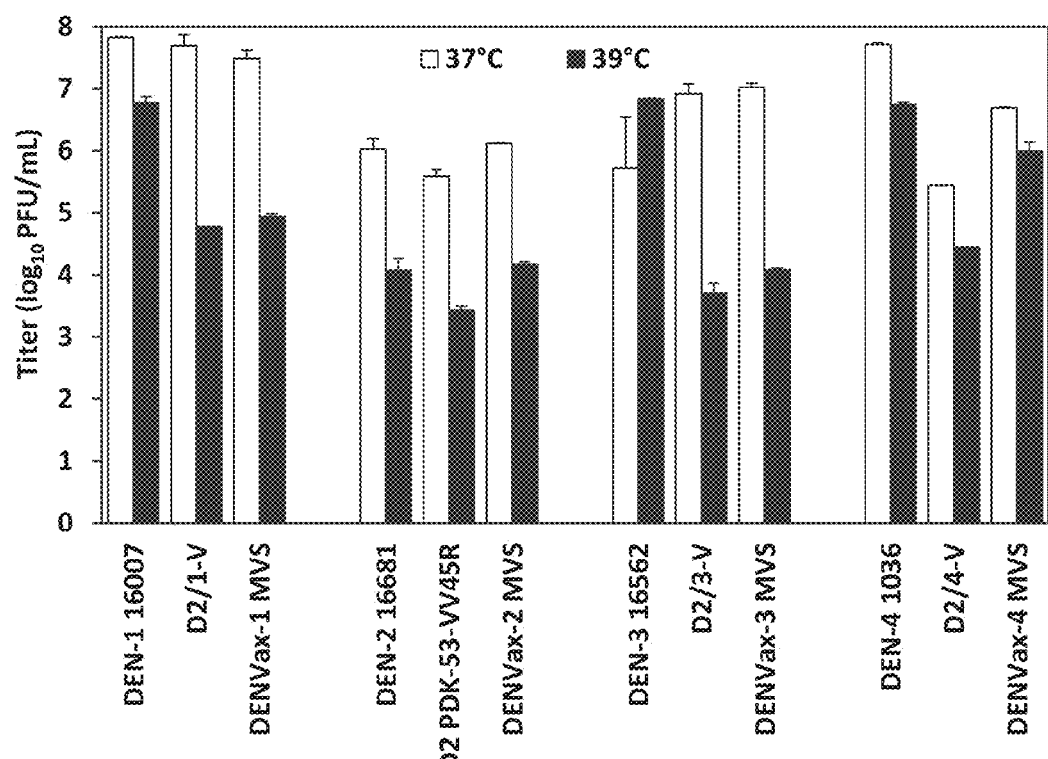
FIG. 7 represents an exemplary histogram plot illustrating growth of DENVax MSV, WVS, and BVS in C6/36 cells at two incubation temperatures to verify their retention of this in vitro attenuation marker after large scale manufacturing.

Previous studies demonstrated that the research-grade PDK-53-based chimeric vaccine viruses retained the attenuation phenotype of the backbone DENV-2 PDK53 virus in C6/36 cells. In some exemplary methods, the DENVax MSV, WVS, and BVS were grown in C6/36 cells to verify their retention of this in vitro attenuation marker after large scale manufacturing. Compared to the wt Dengue viruses, except for DENVax-3, the manufactured seeds showed marked growth reduction (at least 3 $\log_{10}$ PFU/ml reduction) in C6/36 cells on day 6 pi (FIG. 7). The DENVax-3 seeds also exhibited reduced growth compared to the wt DENV-3 16562, but the reduction was not as marked (1-2 $\log_{10}$ PFU/ml reduction). However, the titers of the DENVax-3 seed lots were similar (within 1 $\log_{10}$ PFU/ml difference) to the original research-grade chimeric D2/3-V vaccine virus.

Figure 8:
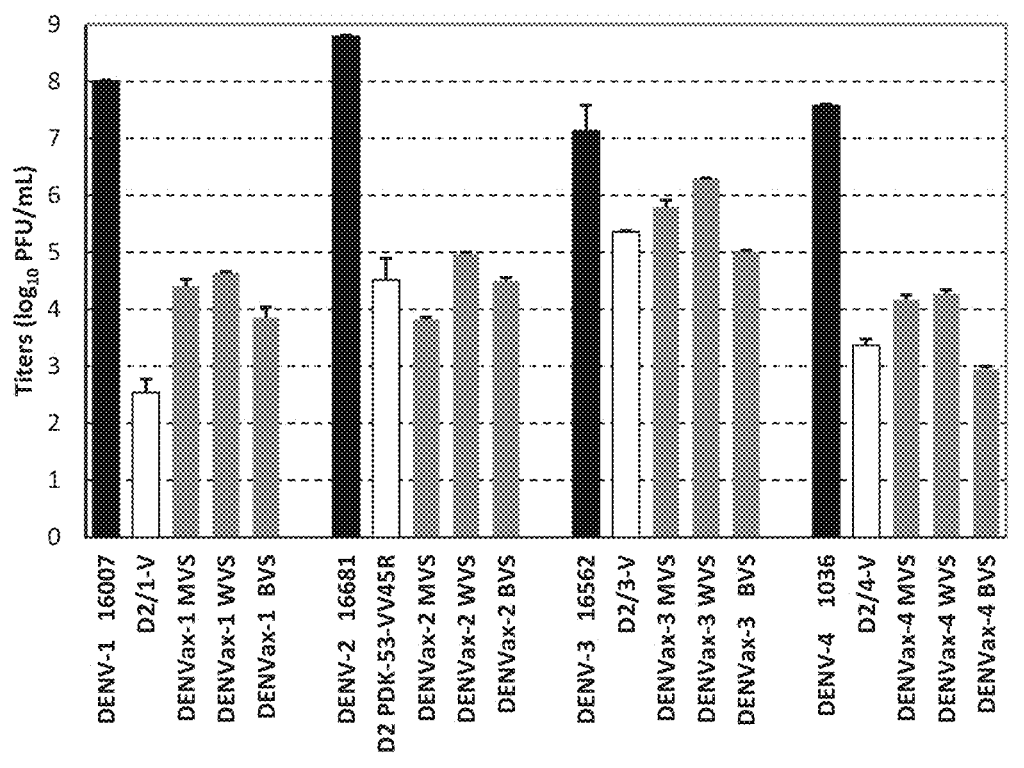

FIG. 8 represents an exemplary histogram plotting restricted growth of DENVax MVS, WVS, and BVS in C6/36 cells. Mean titers±SD (error bars) of the viruses replicated in C6/36 cells 7 days pi. The wt Dengue viruses and previously published research-grade vaccine candidate viruses were included for comparison.

Neurovirulence in Suckling Mice

Additional experiments were performed to analyze neurovirulence in newborn ICR mice. At an intracranial dose of $10^4$ PFU, the survival rates for wt DENV-2 16681 and the D2 PDK-53-VV45R were 0% and 18.8%, respectively (FIG. 9A) in the ICR mice, but were about 20% for wt DENV-2 16681 and 100% for the D2 PDK-53-VV45R in the CDC ICR mice. In this study, DENVax-1 and DENVax-3 MVS were attenuated (100% survival) for the mice at a dose of $10^4$ PFU, but the MVS of DENVax-2 and DENVax-4 caused 100% mortality at the dose of over $10^4$ PFU (FIG. 5A). However, when tested at a dose of $10^3$ PFU of virus, the DENVax-2 (31.3% survival) and DENVax-4 (81.3% survival) showed reduced neurovirulence relative to wt Dengue virus serotype-2 16681 (0% survival), and their survival rates were similar to those of the research-grade vaccine candidates D2 PKD-53-VV45R (32.3%) and D2/4-V (100%), respectively (FIG. 9B). Although, wt DENV-1, -3, or -4 were not included for comparison in this study, previous work demonstrated that wt DENV-1 16007 was attenuated in the CDC-ICR mice by the is route, while both wt DENV-3 16562 and DENV-4 1036 were highly virulent (0% survival) for the CDC-ICR mice. It is likely that these 3 wt DENV would exhibit similar or greater virulence in the more susceptible Taconic ICR mice. Therefore, inclusion of these wt Dengue viruses for comparison with their homologous DENVax MVSs was considered to be uninformative. This study indicated that all 4 DENVax MVSs and original laboratory derived candidate vaccine viruses exhibit comparable mouse attenuation phenotypes relative to the wt DENV-2 16681.

FIGS. 9A-9B represent exemplary graphs of data of neurovirulence of DENVax MVS in newborn ICR mice. (A) IC inoculations of the virus at dose of $10^4$ PFU. (B) IC inoculation of the virus at dose of $10^3$ PFU All seed lots of the DENVax were tested for the identity, sterility, and freedom from undesirable agents. Full-genome sequence analysis revealed that one extra amino acid mutation evolved in the DENVax-4 MVS, while the other 3 DENVax MVSs retained the consensus genome sequence of their pre-master seeds. In WVS lots, the DENVax-3 acquired an extra amino acid mutation and the other 3 serotypes accumulated 2 extra amino acid substitutions, relative to their pre-master seeds. Genome sequences of all the 4 BVS lots were identical to their WVS lots. Overall from the P2 seeds to the pre-master (P7) seeds, only 1 or 2 non-silent mutations occurred in a given seed. Between pre-master and BCS (P10) seeds, only 1 to 2 nucleotide substitutions were observed, all of which occurred in NS2A, 4A, or 4B, with the exception of single nucleotide change resulting in a conserved glycine and alanine at residue E-483. From P2 to BVS (P10) seeds, total 3 to 8 nucleotide substitutions were identified in any given DENVax seed, and only 2 to 4 of these substitutions resulted in amino acid changes. None of the silent mutations in the BVS were within the 5'- or 3'-NCR region which may affects virus replication. These results suggest that the DENVax viruses were genetically highly stable during manufacture. The three defined DENV-2 PDK-53 attenuation loci located in 5'NCR, NS1-53, and NS3-250 remained unchanged in the consensus genome sequence upon serial passage of the DENVax to generate BVS stocks. The highly sensitive TaqMAMA of the 5'-NCR-57 locus showed minimal or undetectable reversion in the MVS, WVS, and BVS of DENVax. The highest reversion rate of 0.21% was identified in the DENVax-2 BVS. The reversion rates of the P10-equivalent BVS (<0.07% to 0.21%) were significantly lower than the reversion rates that evolved in other vaccine candidates after serial passages in Vero cells (4-74% reversion by P10). This suggests that this strategy for large scale manufacturing of the DENVax seeds is successful, regarding maintaining genetic stability and retention of attenuation markers in the candidate vaccine viruses.

Figure 9:
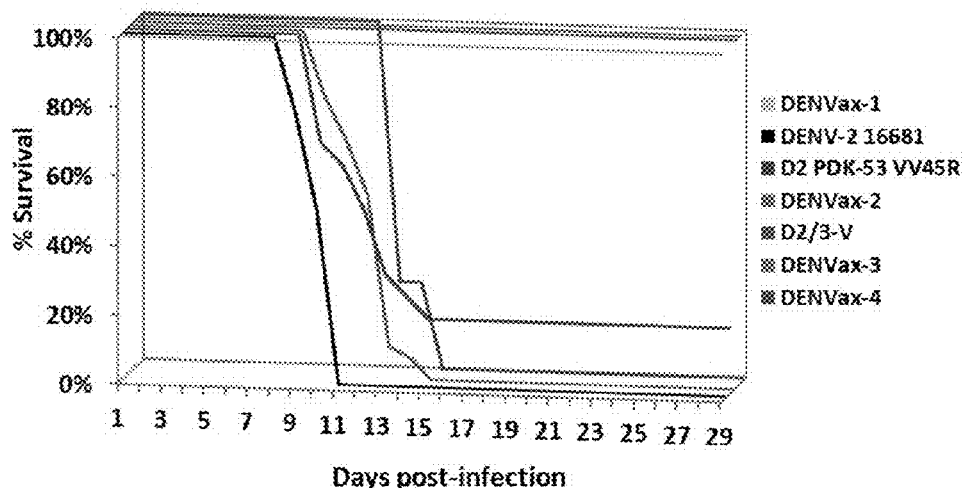
FIGS. 9A-9B represent exemplary graphs of data of neurovirulence of DENVax MVS in newborn ICR mice. (A) IC inoculations of the virus at dose of $10^4$ PFU. (B) IC inoculation of the virus at dose of $10^3$ PFU.
Figure 9:
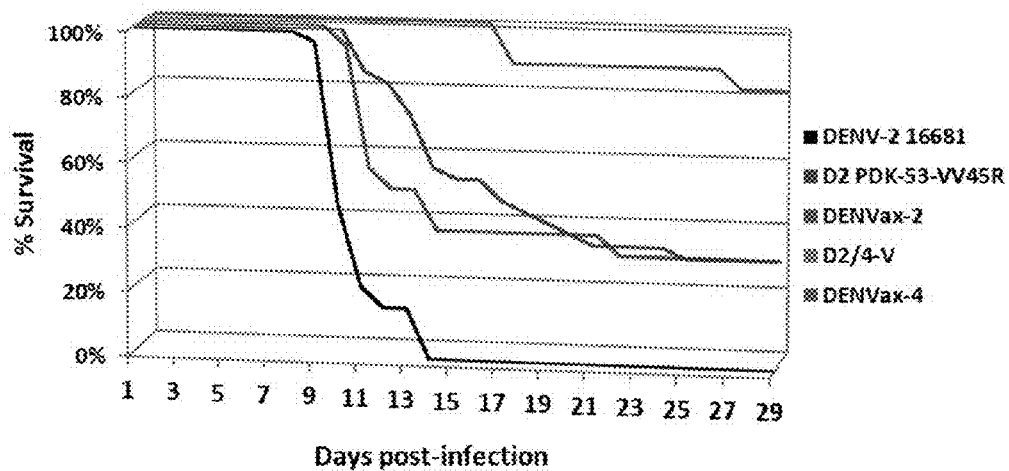

Since MVS stocks disclosed herein will be used for future manufacturing of WVS and BVS lots, full panels of virus attenuation phenotype evaluations, including small plaque phenotype, temperature sensitivity, reduced replication in mosquito cells, reduced infection/dissemination/transmission in whole mosquitoes, and reduced neurovirulence in newborn ICR mice, were conducted for all MVS or their equivalent surrogate stocks. For the WVS and BVS stocks, plaque size, infectivity in mosquito cells, were also performed to confirm their attenuations. Results indicated that all the MVS stocks of the 4 serotypes of DENVax retained the expected attenuation phenotypes, such as small plaques, reduced replication in C6/36 cells, and reduced mouse neurovirulence, similar to the original lab-derived vaccine viruses (FIGS. 6, 8, and 9). Except for the DENVax-4, all other 3 MVS stocks of DENVax were TS at 39° C. as shown in FIGS. 3 and 7.

For the WVS and BVS stocks, two attenuation phenotypes, small plaques and restricted replication in C6/36 cells, were analyzed and confirmed. Since there are very little genetic changes between the MVS and BVS, it was expected that they would retain the attenuation phenotypes as MVS. In addition to the experiments described in this report, safety and immunogenicity of the manufactured DENVax in Ag129 mice and nonhuman primate have been tested.

Exemplary methods are provided herein to demonstrate manufacture of DENVax MVS, WVS, and BVS stocks under cGMP. The BVS stocks were used to formulate the tetravalent DENVax currently in human clinical trial evaluations. A unique manufacture strategy to optimize the genetic stability and safety of the manufactured MVS was provided in some exemplary methods. Since the main attenuation loci of the DENVax have been well characterized previously and a highly sensitive and quantifiable SNP assay, TaqMAMA was developed to integrate genome sequence and the TaqMAMA to identify optimal pre-master seeds for making the MVS. The genetic and phenotypic characterizations of the MVS were fully analyzed to confirm that these viruses retained desirable attenuations for safety of the vaccine. This may be the only live, attenuated viral vaccine that can be efficiently analyzed for all the major attenuation genetic loci during manufacturing from pre-master all the way to BVS stocks. Results provided herein exemplified the advantage of strategically designed live-attenuated vaccines in vaccine safety.

FIG. 10 represents an exemplary table comparing new live, attenuated viruses to previously generated live, attenuated dengue viruses. Mutations are indicated where different from a control virus (e.g. 16681), or other live, attenuated dengue-2 viruses.

Materials and Methods

Viruses and Cells

DENV-1 16007, DENV-2 16681, DENV-3 16562, and DENV-4 1034 served as wild-type (wt) DENV controls, and they were the parental genotype viruses for the four recombinant DENVax vaccine candidates. DENVax progenitor research-grade viruses, designated as D2/1-V, D2 PDK-53-VV45R, D2/3-V, and D2/4-V, were prepared and characterized previously. Vero (African green monkey kidney) cells used for making the master and working cell banks for vaccine production were originated from the American Type Culture Collection (ATCC) CCL81 cell line that has been characterized by the World Health Organization (WHO) for vaccine manufacture (WCB-Vero cells).

Derivation of Live Recombinant DENVax Viruses from cDNA Clones

To re-derive the candidate vaccine viruses under cGMP manufacturing conditions, the previously engineered DENV infectious cDNA clones, pD2-PDK-53-VV45R, pD2/1-V, pD2/4-V, and in vitro-ligated pD2/3-V containing the full genome-length viral cDNAs were used to make fresh viral RNA transcripts by in vitro transcription as described previously. Briefly, XbaI-linearized DENV genomic cDNAs were treated with proteinase K, extracted with phenol/chloroform and precipitated in ethanol to remove any residual proteins, and then suspended in RNase-free Tris-EDTA buffer prior to transcription. The in vitro transcription was conducted using the AmpliScribe T7 High Yield Transcription kit (Epicentre Technologies) following the manufacturer's recommended protocol. The RNA A-cap analog, m7G(5')ppp(5')A (New England BioLabs), was incorporated during the 2-hr transcription reaction to add the 5'-terminal A-cap to the RNA transcript. The samples were then treated with DNase I to digest the template cDNA, followed by low pH phenol/chloroform extraction and ethanol precipitation to remove residual DNA and proteins. The purified RNA transcripts, suspended in RNase-free water, were distributed in 20-µl aliquots and stored at −80° C. until ready for transfection of cells. The integrity and concentration of the RNA transcripts were analyzed by agarose gel electrophoresis. Each 20-µl aliquot was estimated to contain sufficient genome-length viral RNA to permit transfection of $0.4\text{-}1\times10^7$ production-certified Vero cells by electroporation.

Transfection of each RNA transcript into WCB-Vero cells was performed in the cGMP facility at Shantha Biotechnics. DENVax RNA transcripts were thawed, mixed with 400 µl of the Vero cell suspension ($1\times10^7$ cells/ml), and transferred to a pre-chilled sterile electroporation cuvette (4-mm gap) for electroporation by a Gene Pulser Xcell total system (BioRad Laboratories). Each sample was pulsed once at 250V/co Ohms/500 µf, incubated for 10-15 min at room temperature, transferred to a 75-cm$^2$ flask containing 30 ml of cell growth medium (MEM with 10% FBS), and incubated at 36° C.±1° C., 5% $CO_2$ for 6 to 11 days. The culture medium was harvested, clarified by centrifugation, stabilized, and stored in small aliquots below −60° C. The viral titers of candidate vaccine stocks (termed P1 for passage level 1) resulting from transfection were determined by plaque titration assay in Vero cells and used for further propagation of the DENVax seeds.

Manufacture of DENVax Virus Seeds

P1 virus seeds were used to propagate DENVax pre-master, master, working, and bulk virus seed lots through a strategy designed to ensure the optimal genetic stability and safety of the manufactured lots. This strategy included three serial plaque purifications, as well as genetic analyses of viruses at various passage levels to select the optimal clonal virus population for continued seed production (Table 1). Briefly, the P1 seeds harvested from transfected cells were amplified once by infection of Vero cells at a MOI of 0.001 to generate the P2 seeds. Aliquots of the P2 seed stocks were evaluated by plaque morphology and complete viral genomic sequencing. The genetically confirmed P2 stocks were plated on Vero cell monolayers with overlay medium as described in the plaque titration section below to generate well-isolated plaques. After visualization with neutral red, six individual plaques from each of the 4 serotypes of vaccine viruses were isolated (plaque clones A to F) and mixed into 0.5 ml of culture medium (passage P3). Each of the six plaque suspensions was subjected to two additional rounds of plaque purification, resulting in twice- and thrice-plaque purified virus seeds at passages P4 and P5, respectively. The P5 viruses were amplified through two sequential Vero passages to produce P7 seed stocks.

Genetic analysis of the three major DENVax attenuation loci using spot sequencing and/or Taqman-based mismatched amplification mutation assay (TaqMAMA) as previously disclosed, and plaque phenotype analysis were conducted to screen all 24 P7 seeds. Seeds possessing appropriate initial characteristics were then further characterized by full genomic sequencing. As a result of these analyses, one of the 6 (clone A-F) P7 seeds of each DENVax serotype was selected to be the pre-master seed, based on the presence of the DENV-2 PDK-53 attenuating mutations, minimal genomic sequence alterations, and expected plaque phenotype. Each selected pre-master seed was expanded to master virus seed (MVS or P8) by a one-time passage of the virus at MOI of 0.001 in multiple 175 cm$^2$ flasks of Vero cells. Except for the DENVax-4 MVS, the master virus seeds were harvested at 8-10 days post infection (pi). The MVS stocks were harvested at 6-10 days post infection (pi), clarified by centrifugation, stabilized by the addition of sucrose/phosphate/glutamate solution (final concentration 7.5% sucrose, 3.4 mM potassium dihydrogen phosphate, 7.2 mM dipotassium hydrogen phosphate, 5.4 mM monosodium glutamate, respectively) and 0.95 to 1.90% FBS (final concentration). DENVax-4 MVS was prepared differently to optimize its yield. Briefly, multiple flasks of cells were infected with DENVax-4 pre-master seed at a MOI of 0.001 in the presence of 0.1% F-127™, poloxamer 407, (other EO-PO block copolymers have been assessed and may substitute here, see issued patent) that have been demonstrated to enhance DENV virus thermal stability. Infectious media was harvested days 6-10 pi, and stabilized with 17% FBS (final concentration), pooled, and frozen. All four DENVax MVS stocks were stored as 1-ml aliquots below −60° C.

The DENVax working virus seeds (WVS) were prepared by one-time passage in Vero cell culture of the MVS at a MOI of 0.001. The procedures were similar to the production of MVS, except they were cultured in multiple-layer cell factories (6360 cm$^2$). The WVS stocks were filtered through 10 µM and 0.45 µM filters, stabilized with the same stabilizers used for the MVS, aliquoted into 30 ml PETG bottles or 2.0 ml cryovials, and stored below-60° C.

In certain methods, bulk virus seeds (BVS) were produced by infecting multiple cell factories (6360 cm$^2$ each) of confluent Vero cells with 90 mL of diluted WVS to attain a MOI of 0.001. A media used for dilution of the WVS inocula contained 0.1% F-127™ without serum. After 1.5 hr adsorption, cells were washed 3 times with PBS, and 800 ml of serum-free DMEM medium was added to each cell factory, and the factories were incubated at 36(±1)° C. in 5(±0.5)% $CO_2$. After incubation for four days, small aliquots of medium were collected for sterility testing. Viruses were harvested between day 5 and day 10 pi, and immediately clarified by filtration through a 0.45 um pore size filter, and 1 L of each clarified virus pool was stabilized by addition of 500 ml of 3×FTA buffer (final concentrations of 15% trehalose, 1.0% Pluronic® F-127™ poloxamer 407, 0.1% human albumin USP in PBS, pH 7.4). The stabilized virus was distributed into 1-L PETG bottles and stored frozen below −60° C. for subsequent pooling and quality control testing. All stabilized virus harvests with a virus titer above $10^5$ PFU/ml and an acceptable level of residual DNA were rapidly thawed in a water bath at 32° C., then aseptically pooled and mixed. Each pooled monovalent BVS was distributed into labeled PETG containers and stored at below −60° C. until further use.

Manufacture Product Quality Controls

The MVS, WVS, and BVS seeds were tested for identity, sterility, and detectable adventitious agents. The identity of each vaccine stock was confirmed by RT-PCR with DENVax serotype-specific primers. The amplified cDNA fragments contained the E/NS1 chimeric junction site to permit identification of each of the four DENVax serotypes. Each seed was tested in all 4 serotype-specific RT-PCR reactions to confirm viral identity and freedom from cross contamination with heterologous DENVax serotypes. Sterility testing was performed in accordance with USP 71 (United States Pharmacopeia, section 71). Mycoplasma testing was performed.

The following in vitro and in vivo tests for viral contamination were all performed using unclarified, unstabilized DENVax harvests collected during manufacture of the seeds. Harvested infectious media were first neutralized with DENV rabbit polyclonal antiserum (Invirogen) at 36±1° C. for 1 hr to inactivate the DENV. For in vitro test, the neutralized seeds were inoculated into three indicator cells lines, MRCS, VERO and MA104, in 25 $cm^2$ flasks. Echo virus (CPE control) or mumps virus (hemadsorption control) were used as positive CPE or hemadsorption control, respectively. All cells were monitored daily for CPE for a total of 14 days. At the end of 14 days, the culture supernatant was removed and replaced with 10 mL of a guinea pig red blood cell (RBC) solution (3 mL of 0.5% guinea pig RBC in phosphate buffered saline, made up to 10 mL with cell growth medium). The flasks were then incubated at 5±3° C. for 30 minutes followed by incubation at room temperature for 30 minutes. The monolayers were washed with PBS and observed under 10× magnification for the presence of any star-shaped clumps of RBCs for hemadsorption.

In vivo tests for adventitious agents were performed in suckling mice, post-weaning mice and guinea pigs. Suckling mice were inoculated with 0.1 ml or 0.01 ml (10 mice in each dose group) of the DENV-antiserum neutralized seed sample through intraperitoneal (ip) injection. Similarly, 10 post-weaning mice were each inoculated ip with 0.5 ml or 0.03 ml of the sample. Guinea pigs (5/group) were each inoculated ip with 5.0 mL. Suckling mice were observed daily for morbidity and mortality for a total of 14 days following inoculation. Post-weaning mice were observed for a total of 28 days, and guinea pigs were observed for a total of 42 days following inoculation. The test articles met the acceptance criterion if ≥80% of the inoculated animals remained healthy throughout the observation period.

The in vivo testing for contaminants was also performed in embryonated chicken eggs and was conducted. For every sample, 10 embryonated hen eggs (9 days old) were each inoculated with 0.5 mL of the DENV antiserum-neutralized sample into the allantoic fluid and incubated at 35° C. for 3 days. The allantoic fluids from these 10 eggs were harvested, pooled and passaged into the allantoic fluid of 10 fresh embryonated eggs (10-11 days old; 0.5 mL/egg) and incubated at 35° C. for a further 3 days. Similarly, for each sample, 10 embryonated eggs (6-7 days old) were each inoculated with 0.5 mL per egg (DENVax-2 monovalent BVS) or 0.25 mL per egg (DENVax-1, DENVax-3 and DENVax-4 BVS) by injection into the yolk sac and incubated at 35° C. for 9 days. The yolk sacs from these 10 eggs were harvested and pooled, and a 10% suspension was passaged into the yolk sacs of 10 fresh embryonated eggs (6-7 days old; 0.5 mL/egg) and incubated at 35° C. for a further 9 days. Eggs inoculated into the allantoic fluid (both initial and passage inoculations) were observed for viability after 3 days incubation. Both pools of allantoic fluid were tested for hemagglutination activity using chicken, guinea pig and human type 0 erythrocytes at 4° C. and 25° C. Eggs inoculated into the yolk sack (both initial and passage inoculations) were observed for viability after 9 days of incubation.

Virus Plaque Assay and Immunofocus Assay

Virus titers were measured by plaque assay or immunofocus assay using Vero cells. Plaque assays were performed in double agarose overlays in six-well plates of confluent Vero cells as previously described, and they were also used to evaluate the plaque phenotypes of the DENVax seeds. For accurate comparison, plaque sizes of all viruses were measured and compared in the same experiment. After visualization with neutral red on day 9 pi, up to 10 well isolated plaques for each virus were measured for mean plaque size calculation. Fewer plaques were measured for wt DENV-1, -3, and -4, whose larger plaque sizes often did not permit measurement of 10 well-separated plaques.

Because tetravalent DENVax contains all four DENV serotypes, a DENV serotype-specific immunofocus assay was developed to quantitate each DENVax component in the tetravalent formulations. Immunofocus assays of each individual DENVax MVS were compared with the plaque assays to ensure virus titration results were comparable between the two assays. The immunofocus assay was conducted in 6-well plates of confluent Vero cells infected with serially diluted viruses. Cells were overlaid with a balanced salt medium (BSS/YE-LAH medium) containing 0.7% high viscosity carboxymethyl cellulose (Sigma) and incubated for 7 days at 37° C. with 5% $CO_2$. After removal of overlays, cell sheets were washed 3 times with PBS, fixed with cold 80% acetone for 30 min at −20° C., washed once with PBS, and blocked with a blocking buffer containing 2.5% (w/v) nonfat dry milk, 0.5% Triton X-100, 0.05% Tween-20 in PBS at 37° C. for 30 min. Blocked cells were incubated with diluted DENV serotype-specific MAbs, 1F1 (DENV-1), 3H5 (DENV-2), 8A-1 (DENV-3), or 1H10 (DENV-4) in blocking buffer at 37° C. for 1 hour or 4° C. overnight, washed 3 times with washing buffer (0.05% Tween-20 in PBS), and incubated with alkaline phosphatase- or horse radish peroxidase (HRP)-conjugated affinity-pure goat anti-mouse IgG (Jackson Immuno Research Laboratories) at 37° C. for 45-60 min. Plates were washed 3 times before the appropriate substrate, 1-Step NBT/BCIP plus suppressor (Pierce) for alkaline phosphatase or Vector-VIP kit (Vector Labs) for HRP, was added for color development. Color development was stopped by rinsing with water when the foci were fully developed. Stained immunofoci were directly visualized and counted on a light box.

Genetic Sequence

Full length genomes of the MVS and WVS were sequenced (see below). Briefly, viral RNA was extracted from DENVax seeds by using the QIAamp viral RNA kit (Qiagen), and overlapping cDNA fragments covering the entire genome were amplified using the Titan One Tube RT-PCR kit (Roche Applied Science, Inc.). The amplified cDNA fragments were gel purified before sequencing with both forward and reverse primers using the BigDye Terminator v3.1 cycle sequencing kit (Applied Biosystems). Sequence reactions were cleaned using the BigDye XTerminator Purification kit (Applied Biosystems), and run on the 3130xl Genetic analyzer (Applied Biosystems) at DVBD/CDC. The Lasergene SeqMan software (DNAStar, Inc) was used for genome analysis and comparison.

Taqman-Based Mismatch Amplification Mutation Assay (TaqMAMA)

TaqMAMA is a sensitive, quantitative single nucleotide polymorphism assay developed to permit finer assessment of the level of reversion at the 5'NC-57 locus of attenuation, and was further optimized for this study. Extracted viral RNA from MVS and WVS were analyzed by the TaqMAMA with both sets of primers/Taqman probe that are specific to wt or the vaccine 5'NC-57 region. The forward primers used to detect DENV-2 wt and vaccine sequences were D2-41-GC and D2-40-TT, respectively. The 3'-terminal nucleotide of each forward primer matched the specific 5'NCR-57 nucleotide for each virus, while the nucleotide adjacent to the 3'-terminal nucleotide in each primer differed from the DENV-2 viral genomic sequence to enhance the mismatch effect. The reverse primer, CD-207, and the Taqman probe, CD-169F, for both wt and vaccine sets were identical. Sequences of the primers and probe as well as cycling conditions were described previously. The real time RT-PCR was performed with the iQ5 or CFX-95 system (BioRad), using a BioRad iScript RT-PCR (for probes) kit, in a 25-µl reaction containing 5 µl of viral RNA template, 0.4 uM of each primer, and 0.2 uM of the probe. Triplicate reactions for each wt- and vaccine-specific assay were conducted for each sample. Genome copy numbers were determined relative to a standard curve prepared for each viral genotype, where the RNA standards were transcripts derived from plasmids containing nt 1-2670 of each genotype-specific cDNA. In addition, the specificity of the assay was confirmed by testing each RNA standard with the heterologous genotype primer/probe sets to ensure minimum cross-reactivity in every experiment. The results were reported as the percentage of viral genomes showing reversion. Previously, due to higher cross-reactive backgrounds that limited the input RNA levels for this assay, the original detection sensitivity was about 0.1% reversion (discrimination power). Since then, the assay has been further optimized using improved real-time PCR equipment and reaction kits, and the cross-reactive background was decreased considerably at much high levels (7-8 $\log_{10}$ copies) of RNA template input. This optimization resulted in significant improvement of the detection sensitivity, down to 0.01-0.07% reversion.

Virus Replication in Mosquito C6/36 Cells and Temperature Sensitivity in Mammalian Vero Cells The replication phenotypes of the four DENVax MVS stocks and wt DENV-1, -2, -3, and -4 viruses were evaluated in C6/36 mosquito cells (Aedes albopictus). C6/36 cells grown in 6-well plates were infected in duplicate with each virus at a MOI of 0.001 and incubated with 4 ml/well of DMEM medium containing 2% FBS in a 5% $CO_2$ incubator at 28° C. Small aliquots of the culture supernatant were collected for each virus on day 6 pi, mixed with an equal volume of medium containing 40% FBS, and stored at −80° C. until ready for virus plaque titration.

Temperature sensitivity was conducted by comparing viral growth at 39° C. versus growth at 37° C. at five days pi of Vero cells in 6-well plates. Cells were infected in quadruplicate with each virus at a MOI of 0.001 at 37° C. Following adsorption of virus, the infected cultures were incubated with 4 ml/well of DMEM medium containing 2% FBS in 2 separate 5% $CO_2$ incubators, one set (duplicate plates) at 37° C. and the other at 39° C. Aliquots (50-µl) of the culture supernatant were collected on day 5 pi, mixed with an equal volume of DMEM containing 40% of FBS, and stored at −80° C. until ready for virus plaque titration. Incubator temperatures were calibrated with NIST-traceable factory-calibrated thermometers (−1 to 51° C.; ERTCO).

Mosquito Infection, Dissemination, and Transmission

Aedes aegypti mosquitoes used for the study were from a colony established in 2002 from a village near Mae Sot (16' N, 33' E), Thailand. After emerging from larvae, adult mosquitoes were maintained at 28° C. at a 16:8 (light:dark) photoperiod with 10% sucrose solution provided ad libitum. Five-to-seven day old female mosquitoes were used for infectious blood meal feeding or intrathoracic (IT) inoculations. Aliquots of freshly cultured DENVax and wt DENV were used immediately upon harvest (without any freeze-thaw cycle) to make virus blood meals as indicated below for oral infection. Remaining virus supernatants were supplemented with FBS to a final concentration of 20%, and aliquots were stored at −80° C. for future virus plaque titration and IT inoculation experiments. The freshly prepared DENVax seeds for these experiments were amplified from the pre-master seeds in Vero cells, and were considered DENVax MVS equivalents.

Infectious blood meals were prepared by mixing fresh virus at a ratio of 1:1 with defribrinated chicken blood (Colorado Serum Company) on the day of oral infection. Mosquitoes were sugar-starved overnight and then offered the virus:blood mixture for 1 hour using a Hemotek membrane feeding system (Discovery Workshops). A 50-µl aliquot of the blood meal was retained at −80° C. for back-titration of virus doses. Fully-engorged females were sorted under cold anesthesia and placed into cartons with 10% sucrose solution provided ad libitum. Cartons were placed at 28° C. with a photoperiod of 16:8 h (light:dark). After 14 days, 25-30 mosquitoes from each virus group were anesthetized via exposure to triethylamine (Flynap®, Carolina Biological Supply Company) and one hind leg was removed and placed in 0.5 ml of DMEM with 10% FBS and 5% penicillin/streptomycin (100 U/ml and 100 µg/ml respectively). Saliva was collected by inserting the proboscis of the anesthetized mosquito into a capillary tube containing 2.5%

FBS and 25% sucrose solution. Mosquitoes were allowed to salivate for at least 15 minutes and then capillary tubes and bodies were placed into separate tubes containing DMEM. Mosquito bodies, legs and saliva were stored at −80° C. until they were triturated and assayed for infectious virus. For IT inoculation, mosquitoes were cold-anesthetized and inoculated with approximately 50 pfu of virus in 0.34 μl inoculum. Inoculated mosquitoes were kept for 7 days in the same conditions as described above. Mosquitoes were then anesthetized, and their saliva and bodies were collected as described above. Samples were stored at −80° C. until further processing.

To process the samples for virus titration, body and leg samples were homogenized with copper coated BBs (Crossman Corporation, NY) at 24 cycles/second for 4 min using a mixer mill, and then clarified by centrifuging at 3,000×g for 3 min. Saliva samples were centrifuged at 3,000×g for 3 minutes to expel fluid from capillary tubes. Ten-fold dilutions of the body and leg homogenates and saliva samples were tested for presence of infectious virus by plaque assay. Results from bodies, legs, and saliva were used for determining the infection, dissemination, and transmission rates, respectively.

Mouse Neurovirulence

Timed pregnant female ICR mice were obtained from Taconic Labs, and monitored several times each day to determine approximate birth times of pup litters. In a given experiment, approximately 12-24 hours after birth, two litters of eight pups per virus (n=16), was challenged with $10^3$ to $10^4$ pfu of virus in 20 μl of diluent by intracranial (ic) inoculation using a 30-gauge needle. Animals were monitored at least 3 times daily for at least 32 days following challenge. At the first sign of illness (rough fur, hunched back, weight loss, abnormal movement, paralysis, or lethargy) animals were euthanized by lethal anesthetization with isoflurane gas, followed by cervical dislocation. The post-infection day of euthanasia represented the "time to illness/morbidity" or "survival time" for the animal. The animal experiments were conducted following a DVBD/CDC IACUC-approved animal protocol.

Derivation of Master Seed Viruses
DENvax-1 Master Virus Seed (MVS)

Nucleotide sequence of the chimeric viral genome and deduced amino acid sequence of the translated protein are provided herein. Most of the prM-E gene (nt 457 to -2379, underlined) is wild-type (wt) DEN-1 16007 virus specific; the remaining genome is DEN-2 PDK-53 virus specific. All engineered substitutions differ from wt virus (D1 16007 or D2 16681), as well as extra mutations (changes from engineered cDNA clone) detected in the MVS are marked.

Substitutions Included in the Genome and Protein:
Junction sites between D1 (prM-E) and D2 backbone:
  a. MluI (nt 451-456): engineered silent mutation, nt-453 A-to-G
  b. NgoMIV (nt 2380-2385): engineered mutations, nt-2381/2382 TG-to-CC (resulted in E-482 Val-to-Ala change)

D2 PDK-53 virus backbone (change from wt D2 16681): all in bold
  a. 5'-noncoding region (NCR)-57 (nt-57 C-to-T): major attenuation focus (in red)
  b. NS1-53 Gly-to-Asp (nt-2579 G-to-A): major attenuation locus (in red)
  c. NS2A-181 Leu-to-Phe (nt-4018 C-to-T)
  d. NS3-250 Glu-to-Val (nt-5270 A-to-T): major attenuation locus (in red)
  e. nt-5547 (NS3 gene) T-to-C silent mutation
  f. NS4A-75 Gly-to-Ala (nt-6599 G-to-C)
  nt-8571 C-to-T silent mutation of PDK-53 is not engineered in the vaccine virus DEN-1 prM-E (change from wt D1 16007)
  a. Engineered nt-1575 T-to-C silent mutation to remove native XbaI site Additional substitutions found in vaccine seed (0.03% nt different from original clone)

```
    a. NS2A-116 Ile-to-Leu (nt-3823 A-to-C, in bold)
    b. NS2B-92 Glu-to-Asp (nt-4407 A-to-T, in bold)
    c. nt-7311 A-to-G silent mutation (in bold)

NCR-57-T, D2 PDK-53 attenuation locus (wt D2 16681:  C)
>5'-Noncoding Region                           |                                          >C
         10        20        30        40        50        60        70        80        90       100
AGTTGTTAGTCTACGTGGACCGACAAAGACAGATTCTTTGAGGGAGCTAAGCTCAATGTAGTTCTAACAGTTTTTTAATTAGAGAGCAGATCTCTGATGA
                                                                                              M  N 110       120       130       140       150       160       170       180       190       200
ATAACCAACGGAAAAAGGCGAAAAACACGCCTTTCAATATGCTGAAACGCGAGAGAAACCGCGTGTCGACTGTGCAACAGCTGACAAAGAGATTCTCACT
  N  Q  R  K  K  A  K  N  T  P  F  N  M  L  K  R  E  R  N  R  V  S  T  V  Q  Q  L  T  K  R  F  S  L 210       220       230       240       250       260       270       280       290       300
TGGAATGCTGCAGGGACGAGGACCATTAAAACTGTTCATGGCCCTGGTGGCGTTCCTTCGTTTCCTAACAATCCCACCAACAGCAGGGATATTGAAGAGA
   G  M  L  Q  G  R  G  P  L  K  L  F  M  A  L  V  A  F  L  R  F  L  T  I  P  P  T  A  G  I  L  K  R 310       320       330       340       350       360       370       380       390       400
TGGGGAACAATTAAAAAATCAAAAGCTATTAATGTTTTGAGAGGGTTCAGGAAAGAGATTGGAAGGATGCTGAACATCTTGAATAGGAGACGCAGATCTG
 W  G  T  I  K  K  S  K  A  I  N  V  L  R  G  F  R  K  E  I  G  R  M  L  N  I  L  N  R  R  R  S  A
                                              >prM         Beginning of D1 16007 sequence
        410       420       430       440       450       460       470       480       490       500
CAGGCATGATCATTATGCTGATTCCAACAGTGATGGCGTTCCATTAACC G GGGGGAGAGCCGCATATGATAGTTAGCAAGCAGGAAAGAGGGAAA
   G  M  I  I  M  L  I  P  T  V  M  A  F  H  L  T  T  R  G  G  E  P  H  M  I  V  S  K  Q  E  R  G  K
 |
```

```
                                                       Engineered MluI splicing site (nt-453 A-to-G silent)
         510       520       530       540       550       560       570       580       590       600
GTCACTTTTGTTCAAGACCTCTGCAGGTGTCAACATGTGCACCCTCATTGCGATGGATTTGGGAGAGTTGTGTGAGGACACGATGACCTACAAATGCCCC
 S  L  L  F  K  T  S  A  G  V  N  M  C  T  L  I  A  M  D  L  G  E  L  C  E  D  T  M  T  Y  K  C  P 610       620       630       640       650       660       670       680       690       700
CGGATCACTGAGGCGGAACCAGATGACGTTGACTGTTGGTGCAATGCCACGGACACATGGGTGACCTATGGAACGTGCTCTCAAACTGGCGAACACCGAC
 R  I  T  E  A  E  P  D  D  V  D  C  W  C  N  A  T  D  T  W  V  T  Y  G  T  C  S  Q  T  G  E  H  R  R >M
         710       720       730       740       750       760       770       780       790       800
GAGACAAACGTTCCGTCGCATTGGCCCCACACGTGGGGCTTGGCCTAGAAACAAGAGCCGAAACGTGGATGTCCTCTGAAGGTGCTTGGAAACAGATACA
 D  K  R  S  V  A  L  A  P  H  V  G  L  G  L  E  T  R  A  E  T  W  M  S  S  E  G  A  W  K  Q  I  Q 810       820       830       840       850       860       870       880       890       900
AAAAGTAGAGACTTGGGCTCTGAGACATCCAGGATTCACGGTGATAGCCCTTTTTCTAGCACATGCCATAGGAACATCCATCACCCAGAAAGGGATCATT
 K  V  E  T  W  A  L  R  H  P  G  F  T  V  I  A  L  F  L  A  H  A  I  G  T  S  I  T  Q  K  G  I  I >E
         910       920       930       940       950       960       970       980       990       1000
TTCATTTTGCTGATGCTGGTAACACCATCTATGGCCATGCGATGCGTGGGAATAGGCAACAGAGACTTCGTGGAAGGACTGTCAGGAGCAACATGGGTGG
 F  I  L  L  M  L  V  T  P  S  M  A  M  R  C  V  G  I  G  N  R  D  F  V  E  G  L  S  G  A  T  W  V  D 1010      1020      1030      1040      1050      1060      1070      1080      1090      1100
ATGTGGTACTGGAGCATGGAAGTTGCGTCACCACCATGGCAAAAAACAAACCAACACTGGACATTGAACTCTTGAAGACGGAGGTCACAAACCCTGCAGT
  V  V  L  E  H  G  S  C  V  T  T  M  A  K  N  K  P  T  L  D  I  E  L  L  K  T  E  V  T  N  P  A  V 1110      1120      1130      1140      1150      1160      1170      1180      1190      1200
TCTGCGTAAATTGTGCATTGAAGCTAAAATATCAAACACCACCACCGATTCGAGATGTCCAACACAAGGAGAAGCCACACTGGTGGAAGAACAAGACGCG
 L  R  K  L  C  I  E  A  K  I  S  N  T  T  T  D  S  R  C  P  T  Q  G  E  A  T  L  V  E  E  Q  D  A 1210      1220      1230      1240      1250      1260      1270      1280      1290      1300
AACTTTGTGTGCCGACGAACGTTCGTGGACAGAGGCTGGGGCAATGGCTGTGGGCTATTCGGAAAAGGGTAGTCTAATAACGTGTGCCAAGTTTAAGTGTG
 N  F  V  C  R  R  T  F  V  D  R  G  W  G  N  G  C  G  L  F  G  K  G  S  L  I  T  C  A  K  F  K  C  V 1310      1320      1330      1340      1350      1360      1370      1380      1390      1400
TGACAAAACTAGAAGGAAAGATAGTTCAATATGAAAACCTAAAATATTCAGTGATAGTCACCGTCCACACTGGAGATCAGCACCAGGTGGGAAATGAGAC
  T  K  L  E  G  K  I  V  Q  Y  E  N  L  K  Y  S  V  I  V  T  V  H  T  G  D  Q  H  Q  V  G  N  E  T 1410      1420      1430      1440      1450      1460      1470      1480      1490      1500
TACAGAACATGGAACAACTGCAACCATAACACCTCAAGCTCCTACGTCGGAAATACAGCTGACCGACTACGGAACCCTTACATTAGATTGTTCACCTAGG
  T  E  H  G  T  T  A  T  I  T  P  Q  A  P  T  S  E  I  Q  L  T  D  Y  G  T  L  T  L  D  C  S  P  R 1510      1520      1530      1540      1550      1560      1570      1580      1590      1600
ACAGGGCTAGATTTTAACGAGATGGTGTTGCTGACAATGAAAGAAAGATCATGGCTTGTCCACAAACAATGGTTCCTAGACTTACCACTGCCTTGGACCT
  T  G  L  D  F  N  E  M  V  L  L  T  M  K  E  R  S  W  L  V  H  K  Q  W  F  L  D  L  P  L  P  W  T  S
                                                                          |
Engineered silent mutation (nt-1575 T-to-C):  remove the native DEN-1 virus-specific XbaI site 1610      1620      1630      1640      1650      1660      1670      1680      1690      1700
CTGGGGCTTCAACATCCCAAGAGACTTGGAACAGACAAGATTTACTGGTCACATTTAAGACAGCTCATGCAAAGAAGCAGGAAGTAGTCGTACTAGGATC
  G  A  S  T  S  Q  E  T  W  N  R  Q  D  L  L  V  T  F  K  T  A  H  A  K  K  Q  E  V  V  V  L  G  S 1710      1720      1730      1740      1750      1760      1770      1780      1790      1800
ACAAGAAGGAGCAATGCACACTGCGCTGACTGGAGCGACAGAAATCCAAACGTCAGGAACGACAACAATTTTCGCAGGACACCTAAAATGCAGACTAAAA
  Q  E  G  A  M  H  T  A  L  T  G  A  T  E  I  Q  T  S  G  T  T  T  I  F  A  G  H  L  K  C  R  L  K 1810      1820      1830      1840      1850      1860      1870      1880      1890      1900
ATGGACAAACTAACTTTAAAAGGGATGTCATATGTGATGTGCACAGGCTCATTCAAGTTAGAGAAAGAAGTGGCTGAGACCCAGCATGGAACTGTTCTGG
  M  D  K  L  T  L  K  G  M  S  Y  V  M  C  T  G  S  F  K  L  E  K  E  V  A  E  T  Q  H  G  T  V  L  V
```

```
                 1910      1920      1930      1940      1950      1960      1970      1980      1990      2000
         TGCAGGTTAAATATGAAGGAACAGACGCACCATGCAAGATTCCCTTTTCGACCCAAGATGAGAAAGGAGCAACCCAGAATGGGAGATTAATAACAGCCAA
           Q  V  K  Y  E  G  T  D  A  P  C  K  I  P  F  S  T  Q  D  E  K  G  A  T  Q  N  G  R  L  I  T  A  N 2010      2020      2030      2040      2050      2060      2070      2080      2090      2100
         CCCCATAGTCACTGACAAAGAAAAACCAGTCAATATTGAGGCAGAACCACCCTTTGGTGAGAGCTACATCGTGGTAGGAGCAGGTGAAAAAGCTTTGAAA
           P  I  V  T  D  K  E  K  P  V  N  I  E  A  E  P  P  F  G  E  S  Y  I  V  V  G  A  G  E  K  A  L  K 2110      2120      2130      2140      2150      2160      2170      2180      2190      2200
         CTAAGCTGGTTCAAGAAAGGAAGCAGCATAGGGAAAATGTTTGAAGCAACTGCCCGAGGAGCACGAAGGATGGCCATTCTGGGAGACACCGCATGGGACT
           L  S  W  F  K  K  G  S  S  I  G  K  M  F  E  A  T  A  R  G  A  R  R  M  A  I  L  G  D  T  A  W  D  F 2210      2220      2230      2240      2250      2260      2270      2280      2290      2300
         TCGGTTCTATAGGAGGAGTGTTCACGTCTATGGGAAAACTGGTACACCAGGTTTTTGGAACTGCATATGGAGTTTTGTTTAGCGGAGTTTCTTGGACCAT
           G  S  I  G  G  V  F  T  S  M  G  K  L  V  H  Q  V  F  G  T  A  Y  G  V  L  F  S  G  V  S  W  T  M

End of D1 16007 sequence
                                                                                                      |
                 2310      2320      2330      2340      2350      2360      2370      2380      2390      2400
         GAAAATAGGAATAGGGATTCTGCTGACATGGCTAGGATTAAATTCAAGGAACACGTCCCTTTCGATGATGTGCATCGCAGCCGGCATTGTGACACTGTAT
           K  I  G  I  G  I  L  L  T  W  L  G  L  N  S  R  N  T  S  L  S  M  M  C  I  A  A  G  I  V  T  L  Y
                                                                                           |
                 Engineered NgoMIV splicing site, E-482 Val-to-Ala (nt-2381/2382 TG-to-CC)

>NS1
                 2410      2420      2430      2440      2450      2460      2470      2480      2490      2500
         TTGGGAGTCATGGTGCAGGCCGATAGTGGTTGCGTTGTGAGCTGGAAAAACAAAGAACTGAAATGTGGCAGTGGGATTTTCATCACAGACAACGTGCACA
           L  G  V  M  V  Q  A  D  S  G  C  V  V  S  W  K  N  K  E  L  K  C  G  S  G  I  F  I  T  D  N  V  H  T 2510      2520      2530      2540      2550      2560      2570      2580      2590      2600
         CATGGACAGAACAATACAAGTTCCAACCAGAATCCCCTTCAAAACTAGCTTCAGCTATCCAGAAAGCCCATGAAGAGGACATTTGTGGAATCCGCTCAGT
           W  T  E  Q  Y  K  F  Q  P  E  S  P  S  K  L  A  S  A  I  Q  K  A  H  E  E  D  I  C  G  I  R  S  V

D2 PDK-53 NA2-53-Asp attenuation locus (wt D2 16681: Gly, nt-2579-G)

2610      2620      2630      2640      2650      2660      2670      2680      2690      2700
         AACAAGACTGGAGAATCTGATGTGGAAACAAATAACACCAGAATTGAATCACATTCTATCAGAAAATGAGGTGAAGTTAACTATTATGACAGGAGACATC
           T  R  L  E  N  L  M  W  K  Q  I  T  P  E  L  N  H  I  L  S  E  N  E  V  K  L  T  I  M  T  G  D  I 2710      2720      2730      2740      2750      2760      2770      2780      2790      2800
         AAAGGAATCATGCAGGCAGGAAAAACGATCTCTGCGGCCTCAGCCCACTGAGCTGAAGTATTCATGGAAAACATGGGGCAAAGCAAAAATGCTCTCTACAG
           K  G  I  M  Q  A  G  K  R  S  L  R  P  Q  P  T  E  L  K  Y  S  W  K  T  W  G  K  A  K  M  L  S  T  E 2810      2820      2830      2840      2850      2860      2870      2880      2890      2900
         AGTCTCATAACCAGACCTTTCTCATTGATGGCCCCGAAACAGCAGAATGCCCCAACACAAATAGAGCTTGGAATTCGTTGGAAGTTGAAGACTATGGCTT
           S  H  N  Q  T  F  L  I  D  G  P  E  T  A  E  C  P  N  T  N  R  A  W  N  S  L  E  V  E  D  Y  G  F 2910      2920      2930      2940      2950      2960      2970      2980      2990      3000
         TGGAGTATTCACCACCAATATATGGCTAAAATTGAAAGAAAAACAGGATGTATTCTGCGACTCAAAACTCATGTCAGCGGCCATAAAAGACAACAGAGCC
           G  V  F  T  T  N  I  W  L  K  L  K  E  K  Q  D  V  F  C  D  S  K  L  M  S  A  A  I  K  D  N  R  A 3010      3020      3030      3040      3050      3060      3070      3080      3090      3100
         GTCCATGCCGATATGGGTTATTGGATAGAAAGTGCACTCAATGACACATGGAAGATAGAGAAGCCTCTTTCATTGAAGTTAAAAACTGCCACTGGCCAA
           V  H  A  D  M  G  Y  W  I  E  S  A  L  N  D  T  W  K  I  E  K  A  S  F  I  E  V  K  N  C  H  W  P  K 3110      3120      3130      3140      3150      3160      3170      3180      3190      3200
         AATCACACACCCTCTGGAGCAATGGAGTGCTAGAAAGTGAGATGATAATTCCAAAGAATCTCGCTGGACCAGTGTCTCAACACAACTATAGACCAGGCTA
           S  H  T  L  W  S  N  G  V  L  E  S  E  M  I  I  P  K  N  L  A  G  P  V  S  Q  H  N  Y  R  P  G  Y 3210      3220      3230      3240      3250      3260      3270      3280      3290      3300
         CCATACACAAATAACAGGACCATGGCATCTAGGTAAGCTTGAGATGGACTTTGATTTCTGTGATGGAACAACAGTGGTAGTGACTGAGGACTGCGGAAAT
           H  T  Q  I  T  G  P  W  H  L  G  K  L  E  M  D  F  D  F  C  D  G  T  T  V  V  V  T  E  D  C  G  N 3310      3320      3330      3340      3350      3360      3370      3380      3390      3400
         AGAGGACCCTCTTTGAGAACAACCACTGCCTCTGGAAAACTCATAACAGAATGGTGCTGCCGATCTTGCACATTACCACCGCTAAGATACAGAGGTGAGG
           R  G  P  S  L  R  T  T  T  A  S  G  K  L  I  T  E  W  C  C  R  S  C  T  L  P  P  L  R  Y  R  G  E  D

>NS2A
                 3410      3420      3430      3440      3450      3460      3470      3480      3490      3500
         ATGGGTGCTGGTACGGGATGGAAATCAGACCATTGAAGGAGAAAGAGAATTTGGTCAACTCCTTGGTCACAGCTGGACATGGGCAGGTCGACAACTT
           G  C  W  Y  G  M  E  I  R  P  L  K  E  K  E  E  N  L  V  N  S  L  V  T  A  G  H  G  Q  V  D  N  F 3510      3520      3530      3540      3550      3560      3570      3580      3590      3600
         TTCACTAGGAGTCTTGGGAATGGCATTGTTCCTGGAGGAAATGCTTAGGACCCGAGTAGGAACGAAACATGCAATACTACTAGTTGCAGTTTCTTTTGTG
           S  L  G  V  L  G  M  A  L  F  L  E  E  M  L  R  T  R  V  G  T  K  H  A  I  L  L  V  A  V  S  F  V
```

-continued

```
        3610      3620      3630      3640      3650      3660      3670      3680      3690      3700
ACATTGATCACAGGGAACATGTCCTTTAGAGACCTGGGAAGAGTGATGGTTATGGTAGGCGCCACTATGACGGATGACATAGGTATGGGCGTGACTTATC
  T  L  I  T  G  N  M  S  F  R  D  L  G  R  V  M  V  M  V  G  A  T  M  T  D  D  I  G  M  G  V  T  Y  L 3710      3720      3730      3740      3750      3760      3770      3780      3790      3800
TTGCCCTACTAGCAGCCTTCAAAGTCAGACCAACTTTTGCAGCTGGACTACTCTTGAGAAAGCTGACCTCCAAGGAATTGATGATGACTACTATAGGAAT
   A  L  L  A  A  F  K  V  R  P  T  F  A  A  G  L  L  L  R  K  L  T  S  K  E  L  M  M  T  T  I  G  I 3810      3820      3830      3840      3850      3860      3870      3880      3890      3900
TGTACTCCTCTCCCAGAGCACCCTACCAGAGACCATTCTTGAGTTGACTGATGCGTTAGCCTTAGGCATGATGGTCCTCAAAATGGTGAGAAATATGGAA
  V  L  L  S  Q  S  T  L  P  E  T  I  L  E  L  T  D  A  L  A  L  G  M  M  V  L  K  M  V  R  N  M  E
               |
Additional NS2A-116 Ile-to-Leu (nt3823 A-to-C) mutation in master and pre-master seed 3910      3920      3930      3940      3950      3960      3970      3980      3990      4000
AAGTATCAATTGGCAGTGACTATCATGGCTATCTTGTGCGTCCCAAACGCAGTGATATTACAAAACGCATGGAAAGTGAGTTGCACAATATTGGCAGTGG
  K  Y  Q  L  A  V  T  I  M  A  I  L  C  V  P  N  A  V  I  L  Q  N  A  W  K  V  S  C  T  I  L  A  V  V 4010      4020      4030      4040      4050      4060      4070      4080      4090      4100
TGTCCGTTTCCCCACTGTTCTTAACATCCTCACAGCAAAAAACAGATTGGATACCATTAGCATTGACGATCAAAGGTCTCAATCCAACAGCTATTTTTCT
   S  V  S  P  L  F  L  T  S  S  Q  Q  K  T  D  W  I  P  L  A  L  T  I  K  G  L  N  P  T  A  I  F  L
               |
D2 PDK-53 specific NS2A-181-Phe (wt D2 16681: Leu, nt-4018-C)

>NS2B
        4110      4120      4130      4140      4150      4160      4170      4180      4190      4200
AACAACCCTCTCAAGAACCAGCAAGAAAAGGAGCTGGCCATTAAATGAGGCTATCATGGCAGTCGGGATGGTGAGCATTTTAGCCAGTTCTCTCCTAAAA
  T  T  L  S  R  T  S  K  K  R  S  W  P  L  N  E  A  I  M  A  V  G  M  V  S  I  L  A  S  S  L  L  K 4210      4220      4230      4240      4250      4260      4270      4280      4290      4300
AATGATATTCCCATGACAGGACCATTAGTGGCTGGAGGGCTCCTCACTGTGTGCTACGTGCTCACTGGACGATCGGCCGATTTGGAACTGGAGAGAGCAG
  N  D  I  P  M  T  G  P  L  V  A  G  G  L  L  T  V  C  Y  V  L  T  G  R  S  A  D  L  E  L  E  R  A  A 4310      4320      4330      4340      4350      4360      4370      4380      4390      4400
CCGATGTCAAATGGGAAGACCAGGCAGAGATATCAGGAAGCAGTCCAATCCTGTCAATAACAATATCAGAAGATGGTAGCATGTCGATAAAAAATGAAGA
   D  V  K  W  E  D  Q  A  E  I  S  G  S  S  P  I  L  S  I  T  I  S  E  D  G  S  M  S  I  K  N  E  E 4410      4420      4430      4440      4450      4460      4470      4480      4490      4500
GGAAGATCAAACACTGACCATACTCATTAGAACAGGATTGCTGGTGATCTCAGGACTTTTTCCTGTATCAATACCAATCACGGCAGCAGCATGGTACCTG
  E  D  Q  T  L  T  I  L  I  R  T  G  L  L  V  I  S  G  L  F  P  V  S  I  P  I  T  A  A  A  W  Y  L
     |
Additional NS2B-92 Glu-to-Asp (nt-4407 A-to-T) mutation (in master and pre-master seed)

>NS3
        4510      4520      4530      4540      4550      4560      4570      4580      4590      4600
TGGGAAGTGAAGAAACAACGGGCCGGAGTATTGTGGGATGTTCCTTCACCCCCACCCATGGGAAAGGCTGAACTGGAAGATGGAGCCTATAGAATTAAGC
  W  E  V  K  K  Q  R  A  G  V  L  W  D  V  P  S  P  P  P  M  G  K  A  E  L  E  D  G  A  Y  R  I  K  Q 4610      4620      4630      4640      4650      4660      4670      4680      4690      4700
AAAAAGGGATTCTTGGATATTCCCAGATCGGAGCCGGAGTTTACAAAGAAGGAACATTCCATACAATGTGGCATGTCACACGTGGCGCTGTTCTAATGCA
   K  G  I  L  G  Y  S  Q  I  G  A  G  V  Y  K  E  G  T  F  H  T  M  W  H  V  T  R  G  A  V  L  M  H 4710      4720      4730      4740      4750      4760      4770      4780      4790      4800
TAAAGGAAAGAGGATTGAACCATCATGGGCGGACGTCAAGAAAGACCTAATATCATATGGAGGAGGCTGGAAGTTAGAAGGAGAATGGAAGGAAGGAGAA
  K  G  K  R  I  E  P  S  W  A  D  V  K  K  D  L  I  S  Y  G  G  G  W  K  L  E  G  E  W  K  E  G  E 4810      4820      4830      4840      4850      4860      4870      4880      4890      4900
GAAGTCCAGGTATTGGCACTGGAGCCTGGAAAAAATCCAAGAGCCGTCCAAACGAAACCTGGTCTTTTCAAAACCAACGCCGGAACAATAGGTGCTGTAT
  E  V  Q  V  L  A  L  E  P  G  K  N  P  R  A  V  Q  T  K  P  G  L  F  K  T  N  A  G  T  I  G  A  V  S 4910      4920      4930      4940      4950      4960      4970      4980      4990      5000
CTCTGGACTTTTCTCCTGGAACGTCAGGATCTCCAATTATCGACAAAAAAGGAAAAGTTGTGGGTCTTTATGGTAATGGTGTTGTTACAAGGAGTGGAGC
   L  D  F  S  P  G  T  S  G  S  P  I  I  D  K  K  G  K  V  V  G  L  Y  G  N  G  V  V  T  R  S  G  A 5010      5020      5030      5040      5050      5060      5070      5080      5090      5100
ATATGTGAGTGCTATAGCCCAGACTGAAAAAAGCATTGAAGACAACCCAGAGATCGAAGATGACATTTTCCGAAAGAAGACTCGACTCACCATCATGGACCTC
  Y  V  S  A  I  A  Q  T  E  K  S  I  E  D  N  P  E  I  E  D  D  I  F  R  K  R  R  L  T  I  M  D  L 5110      5120      5130      5140      5150      5160      5170      5180      5190      5200
CACCCAGGAGCGGGAAAGACGAAGAGATACCTTCCGGCCATAGTCAGAGAAGCTATAAAACGGGGTTTGAGAACATTAATCTTGGCCCCCACTAGAGTTG
  H  P  G  A  G  K  T  K  R  Y  L  P  A  I  V  R  E  A  I  K  R  G  L  R  T  L  I  L  A  P  T  R  V  V
```

```
              5210       5220       5230       5240       5250       5260       5270       5280       5290       5300
       TGGCAGCTGAAATGGAGGAAGCCCTTAGAGGACTTCCAATAAGATACCAGACCCCAGCCATCAGAGCTGTGCACACCGGGCGGGAGATTGTGGACCTAAT
         A  A  E  M  E  E  A  L  R  G  L  P  I  R  Y  Q  T  P  A  I  R  A  V  H  T  G  R  E  I  V  D  L  M
                                                                             |
                                                 D2 PDK-53 NS3-250-Val attenuation locus (wt D2 16681: Glu, nt-5270-A)

```
      6910      6920      6930      6940      6950      6960      6970      6980      6990      7000
AACATCCTGGACATAGATCTACGTCCTGCATCAGCATGGACGCTGTATGCCGTGGCCACAACATTTGTTACACCAATGTTGAGACATAGCATTGAAAATT
  N  I  L  D  I  D  L  R  P  A  S  A  W  T  L  Y  A  V  A  T  T  F  V  T  P  M  L  R  H  S  I  E  N  S 7010      7020      7030      7040      7050      7060      7070      7080      7090      7100
CCTCAGTGAATGTGTCCCTAACAGCTATAGCCAACCAAGCCACAGTGTTAATGGGTCTCGGGAAAGGATGGCCATTGTCAAAGATGGACATCGGAGTTCC
  S  V  N  V  S  L  T  A  I  A  N  Q  A  T  V  L  M  G  L  G  K  G  W  P  L  S  K  M  D  I  G  V  P 7110      7120      7130      7140      7150      7160      7170      7180      7190      7200
CCTTCTCGCCATTGGATGCTACTCACAAGTCAACCCCATAACTCTCACAGCAGCTCTTTTCTTATTGGTAGCACATTATGCCATCATAGGGCCAGGACTC
  L  L  A  I  G  C  Y  S  Q  V  N  P  I  T  L  T  A  A  L  F  L  L  V  A  H  Y  A  I  I  G  P  G  L 7210      7220      7230      7240      7250      7260      7270      7280      7290      7300
CAAGCAAAAGCAACCAGAGAAGCTCAGAAAAGAGCGGCGGGCATCATGAAAAACCCAACTGTCGATGGAATAACAGTGATTGACCTAGATCCAATAC
  Q  A  K  A  T  R  E  A  Q  K  R  A  A  A  G  I  M  K  N  P  T  V  D  G  I  T  V  I  D  L  D  P  I  P 7310      7320      7330      7340      7350      7360      7370      7380      7390      7400
CTTATGATCCGAAGTTTGAAAAGCAGTTGGGACAAGTAATGCTCCTAGTCCTCTGCGTGACTCAAGTATTGATGATGAGGACTACATGGGCTCTGTGTGA
     Y  D  P  K  F  E  K  Q  L  G  Q  V  M  L  L  V  L  C  V  T  Q  V  L  M  M  R  T  T  W  A  L  C  E
|
Additional silent mutation (nt-7311 A-to-G, in master and pre-master seed)

7410      7420      7430      7440      7450      7460      7470      7480      7490      7500
GGCTTTAACCTTAGCTACCGGGCCCATCTCCACATTGTGGGAAGGAAATCCAGGGAGGTTTTGGAACACTACCATTGCGGTGTCAATGGCTAACATTTTT
  A  L  T  L  A  T  G  P  I  S  T  L  W  E  G  N  P  G  R  F  W  N  T  T  I  A  V  S  M  A  N  I  F

>NS5
      7510      7520      7530      7540      7550      7560      7570      7580      7590      7600
AGAGGGAGTTACTTGGCCGGAGCTGGACTTCTCTTTTCTATTATGAAGAACACAACCAACACAAGAAGGGGAACTGGCAACATAGGAGAGACGCTTGGAG
  R  G  S  Y  L  A  G  A  G  L  L  F  S  I  M  K  N  T  T  N  T  R  R  G  T  G  N  I  G  E  T  L  G  E 7610      7620      7630      7640      7650      7660      7670      7680      7690      7700
AGAAATGGAAAAGCCGATTGAACGCATTGGGAAAAGTGAATTCCAGATCTACAAGAAAAGTGGAATCCAGGAAGTGGATAGAACCTTAGCAAAAGAAGG
  K  W  K  S  R  L  N  A  L  G  K  S  E  F  Q  I  Y  K  K  S  G  I  Q  E  V  D  R  T  L  A  K  E  G 7710      7720      7730      7740      7750      7760      7770      7780      7790      7800
CATTAAAAGAGGAGAAACGGACCATCACGCTGTGTCGCGAGGCTCAGCAAAACTGAGATGGTTCGTTGAGAGAAACATGGTCACACCAGAAGGGAAAGTA
  I  K  R  G  E  T  D  H  H  A  V  S  R  G  S  A  K  L  R  W  F  V  E  R  N  M  V  T  P  E  G  K  V 7810      7820      7830      7840      7850      7860      7870      7880      7890      7900
GTGGACCTCGGTTGTGGCAGAGGAGGCTGGTCATACTATTGTGGAGGACTAAAGAATGTAAGAGAAGTCAAAGGCCTAACAAAAGGAGGACCAGGACACG
  V  D  L  G  C  G  R  G  G  W  S  Y  Y  C  G  G  L  K  N  V  R  E  V  K  G  L  T  K  G  G  P  G  H  E 7910      7920      7930      7940      7950      7960      7970      7980      7990      8000
AAGAACCCATCCCCATGTCAACATATGGGTGGAATCTAGTGCGTCTTCAAAGTGGAGTTGACGTTTTCTTCATCCCGCCAGAAAAGTGTGACACATTATT
  E  P  I  P  M  S  T  Y  G  W  N  L  V  R  L  Q  S  G  V  D  V  F  F  I  P  P  E  K  C  D  T  L  L 8010      8020      8030      8040      8050      8060      8070      8080      8090      8100
GTGTGACATAGGGGAGTCATCACCAAATCCCACAGTGGAAGCAGGACGAACACTCAGAGTCCTTAACTTAGTAGAAAATTGGTTGAACAACAACACTCAA
  C  D  I  G  E  S  S  P  N  P  T  V  E  A  G  R  T  L  R  V  L  N  L  V  E  N  W  L  N  N  N  T  Q 8110      8120      8130      8140      8150      8160      8170      8180      8190      8200
TTTTGCATAAAGGTTCTCAACCCATATATGCCCTCAGTCATAGAAAAAATGGAAGCACTACAAAGGAAATATGGAGGAGCCTTAGTGAGGAATCCACTCT
  P  C  I  K  V  L  N  P  Y  M  P  S  V  I  E  K  M  E  A  L  Q  R  K  Y  G  G  A  L  V  R  N  P  L  S 8210      8220      8230      8240      8250      8260      8270      8280      8290      8300
CACGAAACTCCACACATGAGATGTACTGGGTATCCAATGCTTCCGGGAACATAGTGTCATCAGTGAACATGATTTCAAGGATGTTGATCAACAGATTTAC
  R  N  S  T  H  E  M  Y  W  V  S  N  A  S  G  N  I  V  S  S  V  N  M  I  S  R  M  L  I  N  R  F  T 8310      8320      8330      8340      8350      8360      8370      8380      8390      8400
AATGAGATACAAGAAAGCCACTTACGAGCCGGATGTTGACCTCGGAAGCGGAACCCGTAACATCGGGATTGAAAGTGAGATACCAAACCTAGATATAATT
  M  R  Y  K  K  A  T  Y  E  P  D  V  D  L  G  S  G  T  R  N  I  G  I  E  S  E  I  P  N  L  D  I  I 8410      8420      8430      8440      8450      8460      8470      8480      8490      8500
GGGAAAAGAATAGAAAAAATAAAGCAAGAGCATGAAACATCATGGCACTATGACCAAGACCACCCATACAAAACGTGGGCATACCATGGTAGCTATGAAA
  G  K  R  I  E  K  I  K  Q  E  H  E  T  S  W  H  Y  D  Q  D  H  P  Y  K  T  W  A  Y  H  G  S  Y  E  T 8510      8520      8530      8540      8550      8560      8570      8580      8590      8600
CAAAACGACTGGATCAGCAGCATCATCCATGGTCAACGGAGTGGTCAGGCTGCTGACAAAACCTTGGGACGTCGTCCCCATGGTGACACAGATGGCAATGAC
  K  Q  T  G  S  A  S  S  M  V  N  G  V  V  R  L  L  T  K  P  W  D  V  V  P  M  V  T  Q  M  A  M  T 8610      8620      8630      8640      8650      8660      8670      8680      8690      8700
AGACACGACTCCATTTGGACAACAGCGCGTTTTTAAAGAGAAAGTGGACACGAGAACCCAAGAACCGAAAGAAGGCACGAAGAAACTAATGAAAATAACA
  D  T  T  P  F  G  Q  Q  R  V  F  K  E  K  V  D  T  R  T  Q  E  P  K  E  G  T  K  K  L  M  K  I  T
```

```
      8710      8720      8730      8740      8750      8760      8770      8780      8790      8800
GCAGAGTGGCTTTGGAAAGAATTAGGGAAGAAAAAGACACCCAGGATGTGCACCAGAGAAGAATTCACAAGAAAGGTGAGAAGCAATGCAGCCTTGGGGG
 A  E  W  L  W  K  E  L  G  K  K  K  T  P  R  M  C  T  R  E  E  F  T  R  K  V  R  S  N  A  A  L  G  A 8810      8820      8830      8840      8850      8860      8870      8880      8890      8900
CCATATTCACTGATGAGAACAAGTGGAAGTCGGCACGTGAGGCTGTTGAAGATAGTAGGTTTTGGGAGCTGGTTGACAAGGAAAGGAATCTCCATCTTGA
  I  F  T  D  E  N  K  W  K  S  A  R  E  A  V  E  D  S  R  F  W  E  L  V  D  K  E  R  N  L  H  L  E 8910      8920      8930      8940      8950      8960      8970      8980      8990      9000
AGGAAAGTGTGAAACATGTGTGTACAACATGATGGGAAAAAGAGAGAAGAAGCTAGGGGAATTCGGCAAGGCAAAAGGCAGCAGAGCCATATGGTACATG
 G  K  C  E  T  C  V  Y  N  M  M  G  K  R  E  K  K  L  G  E  F  G  K  A  K  G  S  R  A  I  W  Y  M 9010      9020      9030      9040      9050      9060      9070      9080      9090      9100
TGGCTTGGAGCACGCTTCTTAGAGTTTGAAGCCCTAGGATTCTTAAATGAAGATCACTGGTTCTCCAGAGAGAACTCCCTGAGTGGAGTGGAAGGAGAAG
 W  L  G  A  R  F  L  E  F  E  A  L  G  F  L  N  E  D  H  W  F  S  R  E  N  S  L  S  G  V  E  G  E  G 9110      9120      9130      9140      9150      9160      9170      9180      9190      9200
GGCTGCACAAGCTAGGTTACATTCTAAGAGACGTGAGCAAGAAAGAGGAGGAGCAATGTATGCCGATGACACCGCAGGATGGGATACAAGAATCACACT
  L  H  K  L  G  Y  I  L  R  D  V  S  K  K  E  G  G  A  M  Y  A  D  D  T  A  G  W  D  T  R  I  T  L 9210      9220      9230      9240      9250      9260      9270      9280      9290      9300
AGAAGACCTAAAAAATGAAGAAATGGTAACAAACCACATGGAAGGAGAACACAAGAAACTAGCCGAGGCCATTTTCAAACTAACGTACCAAAACAAGGTG
 E  D  L  K  N  E  E  M  V  T  N  H  M  E  G  E  H  K  K  L  A  E  A  I  F  K  L  T  Y  Q  N  K  V 9310      9320      9330      9340      9350      9360      9370      9380      9390      9400
GTGCGTGTGCAAAGACCAACACCAAGAGGCACAGTAATGGACATCATATCGAGAAGAGACCAAAGAGGTAGTGGACAAGTTGGCACCTATGGACTCAATA
 V  R  V  Q  R  P  T  P  R  G  T  V  M  D  I  I  S  R  R  D  Q  R  G  S  G  Q  V  G  T  Y  G  L  N  T 9410      9420      9430      9440      9450      9460      9470      9480      9490      9500
CTTTCACCAATATGGAAGCCCAACTAATCAGACAGATGGAGGGAGAAGGAGTCTTTAAAAGCATTCAGCACCTAACAATCACAGAAGAAATCGCTGTGCA
  F  T  N  M  E  A  Q  L  I  R  Q  M  E  G  E  G  V  F  K  S  I  Q  H  L  T  I  T  E  E  I  A  V  Q 9510      9520      9530      9540      9550      9560      9570      9580      9590      9600
AAACTGGTTAGCAAGAGTGGGGCGCGAAAGGTTATCAAGAATGGCCATCAGTGGAGATGATTGTGTTGTGAAACCTTTAGATGACAGGTTCGCAAGCGCT
 N  W  L  A  R  V  G  R  E  R  L  S  R  M  A  I  S  G  D  D  C  V  V  K  P  L  D  D  R  F  A  S  A 9610      9620      9630      9640      9650      9660      9670      9680      9690      9700
TTAACAGCTCTAAATGACATGGGAAAGATTAGGAAAGACATACAACAATGGGAACCTTCAAGAGGATGGAATGATTGGACACAAGTGCCCTTCTGTTCAC
 L  T  A  L  N  D  M  G  K  I  R  K  D  I  Q  Q  W  E  P  S  R  G  W  N  D  W  T  Q  V  P  F  C  S  H 9710      9720      9730      9740      9750      9760      9770      9780      9790      9800
ACCATTTTCCATGAGTTAATCATGAAAGACGGTCGCGTACTCGTTGTTCCATGTAGAAACCAAGATGAACTGATTGGCAGAGCCCGAATCTCCCAAGGAGC
  H  F  H  E  L  I  M  K  D  G  R  V  L  V  V  P  C  R  N  Q  D  E  L  I  G  R  A  R  I  S  Q  G  A 9810      9820      9830      9840      9850      9860      9870      9880      9890      9900
AGGGTGGTCTTTTGCGGGAGACGGCCTGTTTGGGGAAGTCTTACGCCCAAATGTGGAGCTTGATGTACTTCCACAGACGCGACCTCAGGCTGGCGGCAAAT
 G  W  S  L  R  E  T  A  C  L  G  K  S  Y  A  Q  M  W  S  L  M  Y  F  H  R  R  D  L  R  L  A  A  N 9910      9920      9930      9940      9950      9960      9970      9980      9990     10000
GCTATTTGCTCGGCAGTACCATCACATTGGGTTCCAACAAGTCGAACCCTGGTCCATACATGCTAAACATGAATGGATGACAACGGAAGACATGCTGA
  A  I  C  S  A  V  P  S  H  W  V  P  T  S  R  T  T  W  S  I  H  A  K  H  E  W  M  T  T  E  D  M  L  T
```

```
            10010     10020     10030     10040     10050     10060     10070     10080     10090     10100
CAGTCTGGAACAGGGTGTGGATTCAAGAAAACCCATGGATGGAAGACAAAACTCCAGTGGAATCATGGGAGGAAATCCCATACTTGGGGAAAAGAGAAGA
     V  W  N  R  V  W  I  Q  E  N  P  W  M  E  D  K  T  P  V  E  S  W  E  E  I  P  Y  L  G  K  R  E  D 10110     10120     10130     10140     10150     10160     10170     10180     10190     10200
CCAATGGTGCGGCTCATTGATTGGGTTAACAAGCAGGGCCACCTGGGCAAAGAACATCCAAGCAGCAATAAATCAAGTTAGATCCCTTATAGGCAATGAA
  Q  W  C  G  S  L  I  G  L  T  S  R  A  T  W  A  K  N  I  Q  A  A  I  N  Q  V  R  S  L  I  G  N  E
                                                                        >3'-Noncoding Region
            10210     10220     10230     10240     10250     10260     10270     10280     10290     10300
GAATACACAGATTACATGCCATCCATGAAAAGATTCAGAAGAGAAGAGGAAGAAGCAGGAGTTCTGTGGTAGAAAGCAAAACTAACATGAAACAAGGCTA
  E  Y  T  D  Y  M  P  S  M  K  R  F  R  R  E  E  E  E  A  G  V  L  W  *

10310     10320     10330     10340     10350     10360     10370     10380     10390     10400
GAAGTCAGGTCGGATTAAGCCATAGTACGGAAAAAACTATGCTACCTGTGAGCCCCGTCCAAGGACGTTAAAAGAAGTCAGGCCATCATAAATGCCATAG 10410     10420     10430     10440     10450     10460     10470     10480     10490     10500
CTTGAGTAAACTATGCAGCCTGTAGCTCCACCTGAGAAGGTGTAAAAAATCCGGGAGGCCACAAACCATGGAAGCTGTACGCATGGCGTAGTGGACTAGC 10510     10520     10530     10540     10550     10560     10570     10580     10590     10600
GGTTAGAGGAGACCCCTCCCTTACAAATCGCAGCAACAATGGGGGCCCAAGGCGAGATGAAGCTGTAGTCTCGCTGGAAGGACTAGAGGTTAGAGGAGAC 10610     10620     10630     10640     10650     10660     10670     10680     10690     10700
CCCCCCGAAACAAAAAACAGCATATTGACGCTGGGAAAGACCAGAGATCCTGCTGTCTCCTCAGCATCATTCCAGGCACAGAACGCCAGAAAATGGAATG 10710     10720
GTGCTGTTGAATCAACAGGTTCT
```

DENvax-2 Master Virus Seed (MVS)

Nucleotide sequence of the recombinant viral genome and deduced amino acid sequence of the translated protein are provided herein. The engineered virus is based on D2 PDK-53 virus. All engineered substitutions that are different from wild-type DEN-2 16681 virus (also the parental virus for PDK-53), as well as extra mutations (changes from engineered cDNA clone) detected in the MVS are marked.
Substitutions Included in the Genome and Protein:
D2 PDK-53 virus backbone (change from wt D2 16681): all in bold
  a. 5'-noncoding region (NCR)-57 (nt-57 C-to-T): major attenuation locus (in red)
  b. prM-29 Asp-to-Val (nt-524 A-to-T)
  c. nt-2055 C-to-T (E gene) silent mutation
  d. NS1-53 Gly-to-Asp (nt-2579 G-to-A): major attenuation locus (in red)
  e. NS2A-181 Leu-to-Phe (nt-4018 C-to-T)
  f. NS3-250 Glu-to-Val (nt-5270 A-to-T): major attenuation locus (in red)
  g. nt-5547 (NS3 gene) T-to-C silent mutation
  h. NS4A-75 Gly-to-Ala (nt-6599 G-to-C)
  nt-8571 C-to-T silent mutation of PDK-53 is not engineered in the vaccine virus
Engineered clone marker (silent mutation):
  a. nt-900 T-to-C silent mutation: infectious clone marker
Additional substitutions found in vaccine seed (0.02% nt different from original clone)

a. prM-52 Lys-to-Glu (nt-592 A-to-G), in bold
b. NS5-412 Ile-to-Val (nt-8803 A-to-G), in bold

```
>5'-NC

-continued

```
      1210      1220      1230      1240      1250      1260      1270      1280      1290      1300      1310      1320
AGGTTCGTCTGCAAACACTCCATGGTAGACAGAGGATGGGGAATGGGCGGACTATTTGGAAAGGGACTTGAAAGAACTGTGAAGAAAA
 R   V   C   K   H   S   M   V   D   R   G   W   N   G   C   G   L   F   G   K   G   I   V   T   C   A   M   F   R   C   K   K   N   M   E   G   K 1330      1340      1350      1360      1370      1380      1390      1400      1410      1420      1430      1440
GTTGTGCAACCAGAGAATTTGGAATACACCATTGTGATAACACACCTTCACTCCAGGGAAGACATGCCAGTCGAAATGACACGGAAAACATGGCCAGTCAAAATAACACCACAGAGT
 V   V   Q   P   E   N   L   E   Y   T   I   V   I   T   P   H   S   G   E   E   H   A   V   G   N   D   T   G   K   H   G   K   E   I   K   I   T   P   Q   S 1450      1460      1470      1480      1490      1500      1510      1520      1530      1540      1550      1560
TCCATCACAGAAGGAGAATTGACAGGTTATGGCACTGTCACAATGGAGTGCTCTCCAGAACGGACTGGCCTGGACTTCAATGAGATGGTGTTGCTGCAGATGGAAAATAAAGCTTGGCTGGTG
 S   I   T   E   A   E   L   T   G   Y   G   T   V   T   M   E   C   S   P   R   T   G   L   D   F   N   E   M   V   L   L   Q   M   E   N   K   A   W   L   V 1570      1580      1590      1600      1610      1620      1630      1640      1650      1660      1670      1680
CACAGGCAATGGTTCCTAGACCTGCCGTTACCATGGTTGCCCGGAGACACAGCAAGGGTCAAATTGCATACAGGAAGACATTGGTCACTTTCAAAAATCCCATGCGAAGAAACAG
 H   R   Q   W   F   L   D   L   P   L   P   W   L   P   G   A   D   T   Q   G   S   N   W   I   Q   K   E   T   L   V   T   F   K   N   P   H   A   K   K   Q 1690      1700      1710      1720      1730      1740      1750      1760      1770      1780      1790      1800
GATGTTGTGTTTAGGATCCGAAGGGGCCATGCACACAGCACTTACAGGGGCCATGCACACAGCACTTACAGGGGCCAATTCCAAGTGTCATCAGAGAAATTACTCTTCCACAGGACCATCCAAGTGCAGGCTGAGA
 D   V   V   L   G   S   Q   E   G   A   M   H   T   A   L   T   G   A   T   E   I   Q   M   S   S   G   N   L   L   F   T   G   H   L   K   C   R   L   R 1810      1820      1830      1840      1850      1860      1870      1880      1890      1900      1910      1920
ATGGACAAGTTACAGCTCAAAGGAATGTCATACTCTATGTGCACTGGAAAGTTTAAAGTTGTGAAGAAAGAAATAGCAGAAACACAATGGATTATCAGAGTGCAATATGAAGGG
 M   D   K   L   Q   L   K   G   M   S   Y   S   M   C   T   G   K   F   K   V   V   K   E   I   A   E   T   Q   H   G   T   I   V   I   R   V   Q   Y   E   G 1930      1940      1950      1960      1970      1980      1990      2000      2010      2020      2030      2040
GACGGCTCTCCATGCAAGATCCCTTTTGAGATAATGGATCTCGAGAAAAGACATGTCCTTAGTCGCCCATTGTGACAAAAAGATAGCCAGTCAGTCAATCATGAA
 D   G   S   P   C   K   I   P   F   E   I   M   D   L   E   K   R   H   V   L   G   R   L   I   T   V   N   P   I   V   T   E   K   D   S   P   V   N   I   E 2050      2060      2070      2080      2090      2100      2110      2120      2130      2140      2150      2160
GCAGAACCTCCATTGGAGACAGCAGCTACATCATCATAGGAGTGGAGCCGGAACAACTGAAGCTCAACTGTCTATCGGCCAAATGTTTGAGACAACAATGAGGGGG
 A   E   P   P   F   G   D   S   Y   I   I   I   G   V   E   P   G   Q   L   K   L   N   W   F   K   K   G   S   S   I   G   Q   M   F   E   T   T   M   R   G
```

D2 PDK-53 nt-2055-T silent mutation (D2 16681: C)

```
>

-continued

```
     2650      2660      2670      2680      2690      2700      2710      2720      2730      2740      2750      2760
GAATTGAATCACATTCTATCGAGAAATGAGTGAAGTTAAGCTAACTATTATGACAGGAGAATCATGCAGGAGAAACGATCTCTGCGCCTCAGCCACTGAGCTGAAGTAT
 E  L  N  H  I  L  S  E  N  E  V  K  L  T  I  M  T  G  D  I  K  G  I  M  Q  A  G  K  R  S  L  R  P  Q  P  T  E  L  K  Y 2770      2780      2790      2800      2810      2820      2830      2840      2850      2860      2870      2880
TCATGGAAAACATGGGCAAAGCAAAATGCTCTCTCTACAGAGTTCATAGCCAGACCTTTCTCATTGATGGCCCCGAAACAGCAGAATGCCCCAACACAAATAGAGCTTGGAATTCGTTG
 S  W  K  T  W  G  K  A  K  M  L  S  T  E  S  H  N  Q  T  F  L  I  D  G  P  E  T  A  E  C  P  N  T  N  R  A  W  N  S  L 2890      2900      2910      2920      2930      2940      2950      2960      2970      2980      2990      3000
GAAGTTGAAGACTATGGCTTTGGAGTATTCACCACCAATATGCTAAAATTGCTAAAATTGAAAGAAAACAGGATGTATTCGGACTCAAAACTCATGTCAGCGGCCATAAAGACAACAGAGCC
 E  V  E  D  Y  G  F  G  V  F  T  T  N  I  W  L  K  L  E  K  Q  D  V  F  C  D  S  K  L  M  S  A  A  I  K  D  N  R  A 3010      3020      3030      3040      3050      3060      3070      3080      3090      3100      3110      3120
GTCCATGCCGATATGGGTTATTGGATAGAAGTGCACTCAATGACACATGGAAAATGGAAAATAGACACAGGAAGTTAAAAACTGCCACTGCCAAAATCACACACCCTCTGGAGC
 V  H  A  D  M  G  Y  W  I  E  S  A  L  N  D  T  W  K  I  E  K  A  S  F  I  E  V  K  N  C  H  W  P  K  S  H  T  L  W  S 3130      3140      3150      3160      3170      3180      3190      3200      3210      3220      3230      3240
AATGAGATGTCTAGAAGTGAATAATTCCAAAGAATCTCGTGACCAGTGTCTCAACACAACTATAGACCAGCTACCATACAAATAACAGGACCATGGCATCTAGGTAAGCTT
 N  G  V  L  E  S  E  M  I  I  P  K  N  L  A  G  P  V  S  Q  H  N  Y  R  P  G  Y  H  T  Q  I  T  G  P  W  H  L  G  K  L 3250      3260      3270      3280      3290      3300      3310      3320      3330      3340      3350      3360
GAGATGGACTTTGATTTCTGTGATGGAACAACAGTGGTAGTGACTGAGGACTGCGGAAATAGAGGACCCTCTTTGAGAACAACACTGCCTCTGGAAAACTCATAACGAATGGTGCTGC
 E  M  D  F  D  F  C  D  G  T  T  V  V  V  T  E  D  C  G  N  R  G  P  S  L  R  T  T  T  A  S  G  K  L  I  T  E  W  C  C

>NS2A
     3370      3380      3390      3400      3410      3420      3430      3440      3450      3460      3470      3480
CGATCTGCACCACCGCTAAGATACAGAGGTGAGGATGGGTGCTGGTACGGAATGGAAATCAGACCATTGAAGGAGAAGAAGAATTGGTCAACTCCTTGGTCACAGCTGGA
 R  S  C  T  L  P  P  L  R  Y  R  G  E  D  G  C  W  Y  G  M  E  I  R  P  L  K  E  K  E  E  N  L  V  N  S  L  V  T  A  G 3490      3500      3510      3520      3530      3540      3550      3560      3570      3580      3590      3600
CATGGCCAGGTCGACAACTTTCACTAGGAGTCTTGGGAATGGCATTGTTCCTGGAGGAAATGCTTAGGACCCGAGTAGGAACAATGCAATACTAGTTGCAGTTTCTTTTGTG
 H  G  Q  V  D  N  F  S  L  G  V  L  G  M  A  L  F  L  E  E  M  L  R  T  R  V  G  T  K  H  A  I  L  L  V  A  V  S  F  V 3610      3620      3630      3640      3650      3660      3670      3680      3690      3700      3710      3720
ACAATTGATCACAGGAACATGTCCTTTAGAGACCTGGGAGGAGTGATGGTTATGGTAGGCGCCACTATGACGGATGACATAGGTATGGGCGTGACTTATCTTGCCCTACTAGCAGCCTTC
 T  L  I  T  G  N  M  S  F  R  D  L  G  R  V  M  V  M  V  G  A  T  M  T  D  D  I  G  M  G  V  T  Y  L  A  L  L  A  A  F 3730      3740      3750      3760      3770      3780      3790      3800      3810      3820      3830      3840
AAAGTGCGACCAACTTTTGCAGCTGGACTCTCTTGAGAAGCTGAAAACTGAGTCACCTGCAGGAAATTGATGATGACTATAGGAATTGTACTCCTCCCAGACCCACCAGAGACCATTCTT
 K  V  R  P  T  F  A  A  G  L  L  L  R  K  L  T  S  K  E  L  M  M  T  T  I  G  I  V  L  L  S  Q  S  T  I  P  E  T  I  L 3850      3860      3870      3880      3890      3900      3910      3920      3930      3940      3950      3960
GAGTGACTGATGCGCTAGCCTTAGGCATGATGGTCCTCAAGATGGTGAGAAATATGGAGAAAATATGGAAAGTGCAGTTAGCTGTCACTATCATGGCAGTGACTATCTGTGCGTCCAAACGCAGTGATATTA
 E  L  T  D  A  L  A  L  G  M  M  V  L  K  M  V  R  N  M  E  K  Y  Q  L  A  V  T  I  M  A  I  L  C  V  P  N  A  V  I  L 3970      3980      3990      4000      4010      4020      4030      4040      4050      4060      4070      4080
CAAAACGCATGGAAAGTGAGTTGCACAATATTGGCAGTTGTGTCCAGTGTCCGTTTCCCACTGTTCTTAACATCCTCACAGCAAAAACAGATTGGATACCATTAGCATTGACGATCAAAGGTCTC
 Q  N  A  W  K  V  S  C  T  I  L  A  V  V  S  S  V  S  P  L  F  L  T  S  S  Q  Q  K  T  D  W  I  P  L  A  L  T  I  K  G  L
```

D2 PDK-53 specific NS2A-181-Phe (wt D

-continued

```
                                                                                                    4200
AATCCAACAGCTATTTTCTCAACAACCCTCTCAAGAACCAGCAGCAAGAAAAGGACCCATTAAATGAGGCTATCATGGCGGTGGTGAGCATTTTAGCCAGTTCTCTCCTAAAA
 N  P  T  A  I  F  L  T  T  L  S  R  T  S  K  K  R  S  N  P  L  N  E  A  I  M  A  V  G  M  V  S  I  L  A  S  S  L  L  K

4320
AATGATATTCCCATGACAGGACCTCTAGTGGCTGGAGGGATCCTCTGTGCTATAATACTGTCAGTCCATGGCGCCGATGTGAAGTGGGAAGAC
 N  D  I  P  M  T  G  P  L  V  A  G  G  L  L  T  V  C  Y  V  L  T  G  R  S  A  D  L  E  L  E  R  A  A  D  V  K  W  E  D

4440
CAGGCAGAGATATCAGGAAGCAGTCCAATCCTGTCAATAACAATATCAGAAGATGGTAGCATGTCGATAAAAAATGAAGAGGAAGAACAAACACTGACCATACTCATTAGAACAGGATTG
 Q  A  E  I  S  G  S  S  P  I  L  S  I  T  I  S  E  D  G  S  M  S  I  K  N  E  E  E  Q  T  L  T  I  L  I  R  T  G  L

>NS3                                                                                                4560
CTGGTGATCTCAGGACTTTTCCTGTATCAATACCGGCAGCACATGGTACCTGTGGGAAGTGAAGAAAAACGGGCCGGAGTATTGTGGGATGTTCTTCACCCCACCCATG
 L  V  I  S  G  L  F  P  P  V  S  I  P  I  T  A  A  A  W  Y  L  W  E  V  K  K  Q  R  A  G  V  L  W  D  V  P  S  P  P  P  M

4680
CTGAAAGGCTGAACTGAACTGGAAGATGGAGCCTATAGACAAAAGAGGGATTCTTGGACAAAAGAATTAAGCAAATGCGGATTCTTCCAGATATTCCCAGATGAAGGACAATTCCATACAATGTGGCATGTCACA
 G  K  A  E  L  E  D  G  A  Y  R  I  K  Q  K  G  I  L  G  Y  S  Q  I  G  A  G  V  Y  K  E  G  T  F  H  T  M  W  H  V  T

4800
CGTGCGCAGAGCTCTTCTAATGCATAAGGAAGAGATTGAACCATCATGGGCTGACGTCAAGAAAGACCTCATCAGCTATGGAGGCGGAGTGAAGTTAGAGGGAGAATGGAAGGAAGGGAGAA
 R  G  A  V  L  M  H  K  G  K  R  I  E  P  S  W  A  D  V  K  K  D  L  I  S  Y  G  G  G  W  K  L  E  G  E  W  K  E  G  E

4920
GAAGTCCAAGTGCTAGAGCCTGGACAAAAGAAAAAACCCCAGAGCTGTGGGTCTTTATGATGGGAATGGAGTTACAAGGGACCCGAGAGTGCTGTATGCCCAGACTAGGTCGTATCTGGACTTTCTCTGA
 E  V  Q  V  L  A  L  E  P  G  K  N  P  R  A  V  Q  T  K  P  G  L  F  K  T  N  A  G  T  I  G  A  V  S  L  D  F  S  P  G

5040
ACGTCAGGAAGCCTCCAATTATCGAACAAAAGGACAAATGACATTTCCGAAGATGATATCTTCAGAAAAAGAAGACTCACTATGGACCTCCACCCCACATGGATGCATATATGTGGAAGCAGGCGGCGGAATGGAGCATATGTGGACCATATGGAC
 T  S  G  S  P  I  I  D  K  K  G  K  V  V  G  L  Y  G  N  G  V  V  V  T  R  S  G  A  Y  V  S  A  I  A  Q  T  E  K  S  I  E

5160
GACAACAGAGCTGAAGATGACATTGAATCTTTCGAACCCAGCATGCTGAAGAAGAGGCAGCTGACTGTTCTGGATCTCCATCCAGGTGCAGGGAAAACCAAGAGATACCTTCCAGCCATAGTCAGAGAAGCTATTAAA
 D  N  P  E  I  E  D  D  I  F  R  K  R  R  L  T  I  M  D  L  H  P  G  A  G  K  T  K  R  Y  L  P  A  I  V  R  E  A  I  K

5280
CGGGGAGTTTGAGAACATTATTAATCTTGGCCGCCACTGAGTTGTGGCCAGCTGTCGACGATTTTTATGCAGAAATGGAAGAGGCCCTTAGAGGGCTTCCAATAAGATACCAGACGCCGGCCATCAGAGCTGTGCACCGGG
 R  G  L  R  T  L  I  L  A  P  T  R  V  V  A  A  E  M  E  E  A  L  R  G  L  P  I  R  Y  Q  T  P  A  I  R  A  V  H  T  G

D2 PDK-53 NS3-250-Val attenuation locus (D2 16681: Glu, nt-5270-A)
                                                                                                    5400
CGGGAGATTGTGGACC -continued -continued

```
                                                        8410      8420      8430      8440      8450      8460      8470      8480      8490      8500      8510      8520
                                                        GGGAAAGAATAGAAAAGATAAAGCAAGACATCATGCACTATGACCAAGACCACCATACAAAACTGGCTAGCCATGTATCATGAAAACAAGACTGGATCAGCA
                                                         G  K  R  I  E  K  I  K  Q  E  H  E  T  S  W  H  Y  D  Q  D  H  P  Y  K  T  W  A  Y  H  G  S  Y  E  T  K  Q  T  G  S  A 8530      8540      8550      8560      8570      8580      8590      8600      8610      8620      8630      8640
                                                        TCATCCATGGTCAACGGAGTTGGTCAGGCTGCTGACAACCTTGAGAAGTGTGAAACATGTGTACAACATGGCAATGGACACAGATGGGACTCCATTTGGACACAAGCGCGTTTTTAAAGAG
                                                         S  S  M  V  N  G  V  V  R  L  L  T  K  P  W  D  V  V  P  M  V  T  Q  M  A  M  T  D  T  T  P  F  G  Q  Q  R  V  F  K  E 8650      8660      8670      8680      8690      8700      8710      8720      8730      8740      8750      8760
                                                        AAAGTGGACACGAGAACCCAAGAATGGAAGGCACGGAGACGAAGAAACTAATGAAAATCACAGCAGAGTGGCTTTGGAAGGAATTAGGAGGAAAGAAAAAGACACCCAGGATGTGCACCAGAGAA
                                                         K  V  D  T  R  T  Q  E  P  P  K  E  G  T  K  K  L  M  K  I  T  A  E  W  L  W  K  E  L  G  K  K  K  T  P  R  M  C  T  R  E 8770      8780      8790      8800      8810      8820      8830      8840      8850      8860      8870      8880
                                                        GAATTCACAAGAAAGGTGAGAAGCAATGGAGTCAGCAATGCCCTGGGGCCTGTATTCACTGATGAGAACAAGTGGAATTCGGCACGTGAAGGCTGTTGAAGATAGTAGGTTTTGGGAGCTGGTTGACAAG
                                                         E  F  T  R  K  V  R  S  N  A  A  L  G  A  V  F  T  D  E  N  K  W  K  S  A  R  E  A  V  E  D  S  R  F  W  E  L  V  D  K 8890      8900      8910      8920      8930      8940      8950      8960      8970      8980      8990      9000
                                                                               Additional NS5-412 Ile-to-Val (nt-8803 A-to-G) mutation in master and pre-master seed
                                                        GAAGGAAATCCATCTTGAAGGAAAGTGTGAAACATGTGTACAACATGTGGGGAATTCGGCAAGAAGCAGCAGCCAAAGGCCAGAGGCCATATGTACATG
                                                         E  R  N  L  H  L  E  G  K  C  E  T  C  V  Y  N  M  M  G  K  R  E  K  K  L  G  E  F  G  K  A  K  G  S  R  A  I  W  Y  M 9010      9020      9030      9040      9050      9060      9070      9080      9090      9100      9110      9120
                                                        TGGCTTGGAGCACGCTTCTTGAAGCCCTAGGATTTCTTAAATGAAGACCACTGGTTCTCCAGAGAGAACTCCCTGAGTGGAGTGGAAGGAGAAGGGCTGCACAAGCTAGGTTAC
                                                         W  L  G  A  R  F  L  E  F  F  E  A  L  G  F  L  N  E  D  H  W  F  S  R  E  N  S  L  S  G  V  E  G  E  G  L  H  K  L  G  Y 9130      9140      9150      9160      9170      9180      9190      9200      9210      9220      9230      9240
                                                        ATTCTAAGAGACGTGAGCAAGAAAAAGGAGGAGAAAGCATGTATGCCAGGCGAATGTATGCCCAGAGAATCACACCAGCTAGAGGATCTAAAAAAATGGTAACAAACCACATG
                                                         I  L  R  D  V  S  K  K  E  G  A  M  Y  A  D  D  T  A  G  W  D  T  R  I  T  L  E  D  L  K  N  E  E  M  V  T  N  H  M 9250      9260      9270      9280      9290      9300      9310      9320      9330      9340      9350      9360
                                                        GAAGGAGAACAGAAACTAGCCCAGGCCATTCAAACTACCAACATACAAAAACAAGTGGTGCGTGCCAAAACAAGTCCCAAGACCACGCATCATATCGAGAAGAGAC
                                                         E  G  E  H  K  K  L  A  E  A  I  F  K  L  T  Y  Q  N  K  V  V  R  V  Q  R  P  T  P  R  G  T  V  M  D  I  I  S  R  R  D 9370      9380      9390      9400      9410      9420      9430      9440      9450      9460      9470      9480
                                                        CAAAGAGGTAGTGGACAAGTTGGCACCTATGGACTCAATACTTTCACCAATATGGAAGCCCAACTAATCAGACAGATGGAAGGAGAAGGAGAGTCTTTAAAAGCATTCAGCACCTAACAATC
                                                         Q  R  G  S  G  Q  V  G  T  Y  G  L  N  T  F  T  N  M  E  A  Q  L  I  R  Q  M  E  G  E  G  V  F  K  S  I  Q  H  L  T  I 9490      9500      9510      9520      9530      9540      9550      9560      9570      9580      9590      9600
                                                        ACAGAGGAGATCGCTGTGCAAAACTGGTTAGCAAGAGTGGGGCGCGAAAGGTTATCAAGAATGGCCATCAGTGGAGATGATTGTGTGAAACCTTTAGATGACAGGTTCGCAAGCGCT
                                                         T  E  E  I  A  V  Q  N  W  L  A  R  V  G  R  E  R  L  S  R  M  A  I  S  G  D  D  C  V  V  K  P  L  D  D  R  F  A  S  A 9610      9620      9630      9640      9650      9660      9670      9680      9690      9700      9710      9720
                                                        TTAACAGCTCTAAATGACATGGGAAAGATTAGGAAAGACATACAACAATGGGAACCTTCAAGAGGATGGAATGATTGGCAACACAAGTGCCCTTCGTTCTTCACACCATTCCATGAGTTAATC
                                                         L  T  A  L  N  D  M  G  K  I  R  K  D  I  Q  Q  W  E  P  S  R  G  W  N  D  W  T  Q  V  P  F  C  S  H  H  F  H  E  L  I 9730      9740      9750      9760      9770      9780      9790      9800      9810      9820      9830      9840
                                                        ATGAAAGACGGTCGCGTACTCGTTGTTCCATGTAGAAACCAAGATGAACTGATTGGCAGAGCCCAAGGACCAGGGGTCTTTTGCGCAGGCGGCTGTTTGGGGAAGTCT
                                                         M  K  D  G  R  V  L  V  V  P  C  R  N  Q  D  E  L  I  G  R  A  R  I  S  Q  G  A  G  W  S  L  R  E  T  A  C  L  G  K  S
```

```
                                                      -continued
      9850       9860       9870       9880       9890       9900       9910       9920       9930       9940       9950       9960
TACGCCCAAATGTGGAGCTTGATGTACTTCCACAGACGCGACCTCAGGCTGGCGGCAARTGCTATTTGCTCGGCAGTACCATCACATTGGGTTCCARCAAGTCGAACAACCTGTCCATA
 Y   A   Q   M   W   S   L   M   Y   F   H   R   R   D   L   R   L   A   A   N   A   I   C   S   A   V   P   S   H   W   V   P   T   S   R   T   T   W   S   I 9970       9980       9990      10000      10010      10020      10030      10040      10050      10060      10070      10080
CATGCTAAACATGAATGAGATGACAACAGAAGACATGCTGACAGTCTGGAACAGGTGTTGGATTCAAGAGAACTCCAGTGGATGGAGGACAAAACTCCAGTGGAATCATGGGAGGAGAATCCCA
 H   A   K   H   E   W   M   T   T   E   D   M   L   T   V   W   N   R   V   W   I   Q   E   N   P   W   M   E   D   K   T   P   V   E   S   W   E   E   I   P 10090      10100      10110      10120      10130      10140      10150      10160      10170      10180      10190      10200
TACTTGGGAAAGAGAGAAGATCAGTGGTGCGGCTCATTGATTGGGTTAACAAGCAGGGCCACCTGGGCAATCCAAGACAGCAATAAATCAAGTTAGATCCCTTATAGGCAATGAA
 Y   L   G   K   R   E   D   Q   W   C   G   S   L   I   G   L   T   S   R   A   T   W   A   K   N   I   Q   A   A   I   N   Q   V   R   S   L   I   G   N   E >3'-NC
     10210      10220      10230      10240      10250      10260      10270      10280      10290      10300      10310      10320
GAATACACAGATTACATGCCATCCATGAAGAGATTCAGAGAGAAGAGGAAGAGCAGGAGTTCTGTGGTAGAAAGACAAAACTACACAAGGCTAGAAGTCAGGTCGGATTAAGC
 E   Y   T   D   Y   M   P   S   M   K   R   F   R   R   E   E   E   E   A   G   V   L   W 10330      10340      10350      10360      10370      10380      10390      10400      10410      10420      10430      10440
CATAGTACGGAAAAAACTATGCTACCTGTGAGCCCCGTCCAAGGACGTTAAAAGAAGTCAGGCCCATGAGTTGAGTAACATGCCATATAAATGCAGCCTGTAGCCTCCACCTGAGAAGG 10450      10460      10470      10480      10490      10500      10510      10520      10530      10540      10550      10560
TGTAAAAAATCCGGAGGCCACACAAACCATGGAAGCTGTACGCATGGCTAGCGGTTAGACTAGTGAGGAGACCCCTCCCTTACAAATCGCAGCAACAATGGGGCCCAAGGCGAGATGA 10570      10580      10590      10600      10610      10620      10630      10640      10650      10660      10670      10680
AGCTGTAGTCTCGCTGGAAGGACTAGAGGTTAGAGGAGACCCCCCCGAAACAAAACAGCATATTGACCGCTGGGAAAGACCAGATCCTGCTGTCCTCCAGCATCATTCCAGGCACA 10690      10700      10710      10720
GAACGCCAGAAAATGAATGGTGCTGTTGAATCAACAGGTTCT
```

DENvax-3 Master Virus Seed (MVS)

Nucleotide sequence of the chimeric viral genome and deduced amino acid sequence of the translated protein are provided herein. Most of the prM-E gene (nt-457 to -2373, underlined) is wild-type (wt) DEN-3 16562 virus-specific; the remaining nucleotide sequence is DEN-2 PDK-53 virus-specific. The E protein of DEN-3 virus has two fewer amino acids than the E protein of DEN-2. Therefore, nt position starting from NgoMIV is 6 nt less than the original DEN-2 PDK-53 nt position. All engineered substitutions differ from wt virus (DEN-3 16562 or DEN-2 16681), as well as extra mutations (changes from engineered cDNA clone) are marked.

Substitutions Included in the Genome and Protein

Junction sites:
a. MluI (nt 451-456): engineered silent mutation, nt-453 A-to-G
b. NgoMIV (nt 2374-2379): engineered mutations, nt-2375/2376 TG-to-CC (resulted in E-480 Val-to-Ala change)

D2 PDK-53 virus backbone (change from wt D2 16681): in bold
a. 5'-noncoding region (NCR)-57 (nt-57 C-to-T): major attenuation locus (in red)
b. NS1-53 Gly-to-Asp (nt-2573 G-to-A): major attenuation locus (in red)
c. NS2A-181 Leu-to-Phe (nt-4012 C-to-T)
d. NS3-250 Glu-to-Val (nt-5264 A-to-T): major attenuation locus (in red)
e. nt-5541 (NS3 gene) T-to-C silent mutation
f. NS4A-75 Gly-to-Ala (nt-6593 G-to-C)

nt-8565 C-to-T silent mutation of PDK-53 is not engineered in the vaccine virus

Engineered mutation in DEN-3 prM-E (change from wt D3 16562)
a. Engineered nt-552 C-to-T silent mutation: clone marker
b. Engineered E-345 His-to-Leu (nt-1970 A-to-T) for efficient replication in cultures Additional substitutions found in vaccine seed (0.02% nt different from original clone)

a. E-223 Thr-to-Ser mutation (nt-1603 A-to-T, in bold)
b. nt-7620 A-to-G silent mutation (in bold)

```
                   NCR-57-T, D2 PDK-53 attenuation locus (wt D2 16681:C)
                                                    |
> 5'-Noncoding Region                                                                    > C
        10        20        30        40        50        60        70        80        90       100
AGTTGTTAGTCTACGTGGACCGACAAAGACAGATTCTTTGAGGGAGCTAAGCTCAATGTAGTTCTAACAGTTTTTTAATTAGAGAGCAGATCTCTGATGA
                                                                                            M   N
       110       120       130       140       150       160       170       180       190       200
ATAACCAACGGAAAAAGGCGAAAAACACGCCTTTCAATATGCTGAAACGCGAGAGAAACCGCGTGTCGACTGTGCAACAGCTGACAAAGAGATTCTCACT
  N  Q  R  K  K  A  K  N  T  P  F  N  M  L  K  R  E  R  N  R  V  S  T  V  Q  Q  L  T  K  R  F  S  L 210       220       230       240       250       260       270       280       290       300
TGGAATGCTGCAGGGACGAGGACCATTAAAACTGTTCATGGCCCTGGTGGCGTTCCTTCGTTTCCTAACAATCCCACCAACAGCAGGGATATTGAAGAGA
  G  M  L  Q  G  R  G  P  L  K  L  F  M  A  L  V  A  F  L  R  F  L  T  I  P  P  T  A  G  I  L  K  R 310       320       330       340       350       360       370       380       390       400
TGGGGAACAATTAAAAAATCAAAAGCTATTAATGTTTTGAGAGGGTTCAGGAAAGAGATTGGAAGGATGCTGAACATCTTGAATAGGAGACGCAGATCTG
  W  G  T  I  K  K  S  K  A  I  N  V  L  R  G  F  R  K  E  I  G  R  M  L  N  I  L  N  R  R  R  S  A > prM          Beginning of D3 16562 sequence
       410       420       430       440       450       460       470       480       490       500
CAGGCATGATCATTATGCTGATTCCAACAGTGATGGCGTTCCATTTAACCACGCGTGATGGAGAGCCGCGCATGATTGTGGGGAAGAATGAAAGAGGAAA
  G  M  I  I  M  L  I  P  T  V  M  A  F  H  L  T  T  R  D  G  E  P  R  M  I  V  G  K  N  E  R  G  K
                                                  |
                                 Engineered MluI splicing site (nt-453 A-to-G silent mutation)
       510       520       530       540       550       560       570       580       590       600
ATCCCTACTTTTCAAGACAGCCTCTGGAATCAACATGTGCACACTCATAGCTATGGATCTGGGAGAGATGTGTGATGACACGGTCACTTACAAATGCCCC
  S  L  L  F  K  T  A  S  G  I  N  M  C  T  L  I  A  M  D  L  G  E  M  C  D  D  T  V  T  Y  K  C  P
                                                 |
                                Silent C-to-T nt mutation as clone marker
       610       620       630       640       650       660       670       680       690       700
CACATTACCGAAGTGGAGCCTGAAGACATTGACTGCTGGTGCAACCTTACATCGACATGGGTGACTTATGGAACATGCAATCAAGCTGGAGAGCATAGAC
  H  I  T  E  V  E  P  E  D  I  D  C  W  C  N  L  T  S  T  W  V  T  Y  G  T  C  N  Q  A  G  E  H  R  R > M
       710       720       730       740       750       760       770       780       790       800
GCGATAAGAGATCAGTGGCGTTAGCTCCCCATGTTGGCATGGGACTGGACACACGCACTCAAACCTGGATGTCGGCTGAAGGAGCTTGGAGACAAGTCGA
  D  K  R  S  V  A  L  A  P  H  V  G  M  G  L  D  T  R  T  Q  T  W  M  S  A  E  G  A  W  R  Q  V  E 810       820       830       840       850       860       870       880       890       900
GAAGGTAGAGACATGGGCCCTTAGGCACCCAGGGTTTACCATACTAGCCCTATTTCTTGCCCATTACATAGGCACTTCCTTGACCCAGAAAGTGGTTATT
  K  V  E  T  W  A  L  R  H  P  G  F  T  I  L  A  L  F  L  A  H  Y  I  G  T  S  L  T  Q  K  V  V  I > E
       910       920       930       940       950       960       970       980       990      1000
TTTATACTATTAATGCTGGTTACCCCATCCATGACAATGAGATGTGTAGGAGTAGGAAACAGAGATTTTGTGGAAGGCCTATCGGGAGCTACGTGGGTTG
  F  I  L  L  M  L  V  T  P  S  M  T  M  R  C  V  G  V  G  N  R  D  F  V  E  G  L  S  G  A  T  W  V  D
```

```
      1010       1020       1030       1040       1050       1060       1070       1080       1090       1100
ACGTGGTGCTCGAGCACGGTGGGTGTGTGACTACCATGGCTAAGAACAAGCCCACGCTGGACATAGAGCTTCAGAAGACCGAGGCCACCCAACTGGCGAC
  V  V  L  E  H  G  G  C  V  T  T  M  A  K  N  K  P  T  L  D  I  E  L  Q  K  T  E  A  T  Q  L  A  T 1110       1120       1130       1140       1150       1160       1170       1180       1190       1200
CCTAAGGAAGCTATGCATTGAGGGAAAAATTACCAACATAACAACCGACTCAAGATGTCCCACCCAAGGGGAAGCGATTTTACCTGAGGAGCAGGACCAG
 L  R  K  L  C  I  E  G  K  I  T  N  I  T  T  D  S  R  C  P  T  Q  G  E  A  I  L  P  E  E  Q  D  Q 1210       1220       1230       1240       1250       1260       1270       1280       1290       1300
AACTACGTGTGTAAGCATACATACGTGGACAGAGGCTGGGGAAACGGTTGTGGTTTGTTTGGCAAGGGAAGCTTGGTGACATGCGCGAAATTTCAATGTT
 N  Y  V  C  K  H  T  T  V  D  R  G  W  G  N  G  C  G  L  F  G  K  G  S  L  V  T  C  A  K  F  Q  C  L 1310       1320       1330       1340       1350       1360       1370       1380       1390       1400
TAGAATCAATAGAGGGAAAAGTGGTGCAACATGAGAACCTCAAATACACCGTCATCATCACAGTGCACACAGGAGACCAACACCAGGTGGGAAATGAAAC
 E  S  I  E  G  K  V  V  Q  H  E  N  L  K  Y  T  V  I  I  T  V  H  T  G  D  Q  H  Q  V  G  N  E  T 1410       1420       1430       1440       1450       1460       1470       1480       1490       1500
GCAGGGAGTCACGGCTGAGATAACACCCCAGGCATCAACCGCTGAAGCCATTTTACCTGAATATGGAACCCTCGGGCTAGAATGCTCACCACGGACAGGT
 Q  G  V  T  A  E  I  T  P  Q  A  S  T  A  E  A  I  L  P  E  Y  G  T  L  G  L  E  C  S  P  R  T  G 1510       1520       1530       1540       1550       1560       1570       1580       1590       1600
TTGGATTTCAATGAAATGATCTCATTGACAATGAAGAACAAAGCATGGATGGTACATAGACAATGGTTCTTTGACTTACCCCTACCATGGACATCAGGAG
 L  D  F  N  E  M  I  S  L  T  M  K  N  K  A  W  M  V  H  R  Q  W  F  F  D  L  P  L  P  W  T  S  G  A 1610       1620       1630       1640       1650       1660       1670       1680       1690       1700
CTTCAGCAGAAACACCAACTTGGAACAGGAAAGAGCTTCTTGTGACATTTAAAAATGCACATGCAAAAAAGCAAGAAGTAGTTGTTCTTGGATCACAAGA
  S  A  E  T  P  T  W  N  R  K  E  L  L  V  T  F  K  N  A  H  A  K  K  Q  E  V  V  V  L  G  S  Q  E
                                                                                |
Additional E-233 Thr-to-Ser mutation (wt D3 16562: nt-1603 A) in master and pre-master seed
      1710       1720       1730       1740       1750       1760       1770       1780       1790       1800
GGGAGCAATGCATACAGCACTGACAGGAGCTACAGAGATCCAAACCTCAGGAGGCACAAGTATCTTTGCGGGGCACTTAAAATGTAGACTCAAGATGGAC
 G  A  M  H  T  A  L  T  G  A  T  E  I  Q  T  S  G  G  T  S  I  F  A  G  H  L  K  C  R  L  K  M  D 1810       1820       1830       1840       1850       1860       1870       1880       1890       1900
AAATTGGAACTCAAGGGGATGAGCTATGCAATGTGCTTGAGTAGCTTTGTGTTGAAGAAAGAAGTCTCCGAAACGCAGCATGGGACAATACTCATTAAGG
 K  L  E  L  K  G  M  S  Y  A  M  C  L  S  S  F  V  L  K  K  E  V  S  E  T  Q  H  G  T  I  L  I  K  V 1910       1920       1930       1940       1950       1960       1970       1980       1990       2000
TTGAGTACAAAGGGGAAGATGCACCCTGCAAGATTCCTTTCTCCACGGAGGATGGACAAGGAAAAGCTCTCAATGGCAGACTGATCACAGCCAATCCAGT
  E  Y  K  G  E  D  A  P  C  K  I  P  F  S  T  E  D  G  Q  G  K  A  L  N  G  R  L  I  T  A  N  P  V
                                                                       |
                              Engineered E-345 His-to-Leu (wt D3 16562: nt-1970-A) for efficient growth
      2010       2020       2030       2040       2050       2060       2070       2080       2090       2100
GGTGACCAAGAAGGAGGAGCCTGTCAACATTGAGGCTGAACCTCCTTTTGGAGAAAGTAACATAGTAATTGGAATTGGAGACAAAGCCCTGAAAATCAAC
 V  T  K  K  E  E  P  V  N  I  E  A  E  P  P  F  G  E  S  N  I  V  I  G  I  G  D  K  A  L  K  I  N 2110       2120       2130       2140       2150       2160       2170       2180       2190       2200
TGGTACAAGAAGGGAAGCTCGATTGGGAAGATGTTCGAGGCCACTGCCAGAGGTGCAAGGCGCATGGCCATCTTGGGAGACACAGCCTGGGACTTTGGAT
 W  Y  K  K  G  S  S  I  G  K  M  F  E  A  T  A  R  G  A  R  R  M  A  I  L  G  D  T  A  W  D  F  G  S 2210       2220       2230       2240       2250       2260       2270       2280       2290       2300
CAGTGGGTGGTGTTTTGAATTCATTAGGGAAAATGGTCCACCAAATATTTGGGAGTGCTTACACAGCCCTATTTGGTGGAGTCTCCTGGATGATGAAAAT
 V  G  G  V  L  N  S  L  G  K  M  V  H  Q  I  F  G  S  A  Y  T  A  L  F  G  G  V  S  W  M  M  K  I
                                                                                  End of D3 16562 sequence
      2310       2320       2330       2340       2350       2360       2370    |  2380       2390       2400
TGGAATAGGTGTCCTCTTAACCTGGATAGGGTTGAACTCAAAAAATACTTCTATGTCATTTTCATGCATCGCGGCCGGCATTGTGACACTGTATTTGGGA
 G  I  G  V  L  L  T  W  I  G  L  N  S  K  N  T  S  M  S  F  S  C  I  A  A  G  I  V  T  L  Y  L  G
                                                                |
                       Engineered NgoMIV splicing site, E-480 Val-to-Ala (nt-2375/2376 TG-to-CC)
            >NS1
      2410       2420       2430       2440       2450       2460       2470       2480       2490       2500
GTCATGGTGCAGGCCGATAGTGGTTGCGTTGTGAGCTGGAAAAACAAAGAACTGAAATGTGGCAGTGGGATTTTCATCACAGACAACGTGCACACATGGA
 V  M  V  Q  A  D  S  G  C  V  V  S  W  K  N  K  E  L  K  C  G  S  G  I  F  I  T  D  N  V  H  T  W  T 2510       2520       2530       2540       2550       2560       2570       2580       2590       2600
CAGAACAATACAAGTTCCAACCAGAATCCCCTTCAAAACTAGCTTCAGCTATCCAGAAAGCCCATGAAGAGGACATTTGTGGAATCCGCTCAGTAACAAG
  E  Q  Y  K  F  Q  P  E  S  P  S  K  L  A  S  A  I  Q  K  A  H  E  E  D  I  C  G  I  R  S  V  T  R
                                                                              |
                              D2 PDK-53 NS1-53-Asp attenuation locus (wt D2 16681: Gly, nt-2573-G)
      2610       2620       2630       2640       2650       2660       2670       2680       2690       2700
ACTGGAGAATCTGATGTGGAAACAAATAACACCAGAATTGAATCACATTCTATCAGAAAATGAGGTGAAGTTAACTATTATGACAGGAGACATCAAAGGA
 L  E  N  L  M  W  K  Q  I  T  P  E  L  N  H  I  L  S  E  N  E  V  K  L  T  I  M  T  G  D  I  K  G
```

```
      2710       2720       2730       2740       2750       2760       2770       2780       2790       2800
ATCATGCAGGCAGGAAAACGATCTCTGCGGCCTCAGCCCACTGAGCTGAAGTATTCATGGAAAACATGGGGCAAAGCAAAAATGCTCTCTACAGAGTCTC
 I  M  Q  A  G  K  R  S  L  R  P  Q  P  T  E  L  K  Y  S  W  K  T  W  G  K  A  K  M  L  S  T  E  S  H 2810       2820       2830       2840       2850       2860       2870       2880       2890       2900
ATAACCAGACCTTTCTCATTGATGGCCCCGAAACAGCAGAATGCCCCAACACAAATAGAGCTTGGAATTCGTTGGAAGTTGAAGACTATGGCTTTGGAGT
 N  Q  T  F  L  I  D  G  P  E  T  A  E  C  P  N  T  N  R  A  W  N  S  L  E  V  E  D  Y  G  F  G  V 2910       2920       2930       2940       2950       2960       2970       2980       2990       3000
ATTCACCACCAATATATGGCTAAAATTGAAAGAAAAACAGGATGTATTCTGCGACTCAAAACTCATGTCAGCGGCCATAAAAGACAACAGAGCCGTCCAT
 F  T  T  N  I  W  L  K  L  K  E  K  Q  D  V  F  C  D  S  K  L  M  S  A  A  I  K  D  N  R  A  V  H 3010       3020       3030       3040       3050       3060       3070       3080       3090       3100
GCCGATATGGGTTATTGGATAGAAAGTGCACTCAATGACACATGGAAGATAGAGAAAGCCTCTTTCATTGAAGTTAAAAACTGCCACTGGCCAAAATCAC
 A  D  M  G  Y  W  I  E  S  A  L  N  D  T  W  K  I  E  K  A  S  F  I  E  V  K  N  C  H  W  P  K  S  H 3110       3120       3130       3140       3150       3160       3170       3180       3190       3200
ACACCCTCTGGAGCAATGGAGTGCTAGAAAGTGAGATGATAATTCCAAAGAATCTCGCTGGACCAGTGTCTCAACAACTATAGACCAGGCTACCATAC
 T  L  W  S  N  G  V  L  E  S  E  M  I  I  P  K  N  L  A  G  P  V  S  Q  H  N  Y  R  P  G  Y  H  T 3210       3220       3230       3240       3250       3260       3270       3280       3290       3300
ACAAATAACAGGACCATGGCATCTAGGTAAGCTTGAGATGGACTTTGATTTCTGTGATGGAACAACAGTGGTAGTGACTGAGGACTGCGGAAATAGAGGA
 Q  I  T  G  P  W  H  L  G  K  L  E  M  D  F  D  F  C  D  G  T  T  V  V  V  T  E  D  C  G  N  R  G 3310       3320       3330       3340       3350       3360       3370       3380       3390       3400
CCCTCTTTGAGAACAACCACTGCCTCTGGAAAACTCATAACAGAATGGTGCTGCCGATCTTGCACATTACCACCGCTAAGATACAGAGGTGAGGATGGGT
 P  S  L  R  T  T  T  A  S  G  K  L  I  T  E  W  C  C  R  S  C  T  L  P  P  L  R  Y  R  G  E  D  G  C

> NS2A
      3410       3420       3430       3440       3450       3460       3470       3480       3490       3500
GCTGGTACGGGATGGAAATCAGACCATTGAAGGAGAAAGAAGAGAATTTGGTCAACTCCTTGGTCACAGCTGGACATGGGCAGGTCGACAACTTTTCACT
 W  Y  G  M  E  I  R  P  L  K  E  K  E  E  N  L  V  N  S  L  V  T  A  G  H  G  Q  V  D  N  F  S  L 3510       3520       3530       3540       3550       3560       3570       3580       3590       3600
AGGAGTCTTGGGAATGGCATTGTTCCTGGAGGAAATGCTTAGGACCCGAGTAGGAACGAAACATGCAATACTACTAGTTGCAGTTTCTTTTGTGACATTG
 G  V  L  G  M  A  L  F  L  E  E  M  L  R  T  R  V  G  T  K  H  A  I  L  L  V  A  V  S  F  V  T  L 3610       3620       3630       3640       3650       3660       3670       3680       3690       3700
ATCACAGGGAACATGTCCTTTAGAGACCTGGGAAGAGTGATGGTTATGGTAGGCGCCACTATGACGGATGACATAGGTATGGGCGTGACTTATCTTGCCC
 I  T  G  N  M  S  F  R  D  L  G  R  V  M  V  M  V  G  A  T  M  T  D  D  I  G  M  G  V  T  Y  L  A  L 3710       3720       3730       3740       3750       3760       3770       3780       3790       3800
TACTAGCAGCCTTCAAAGTCAGACCAACTTTTGCAGCTGGACTACTCTTGAGAAAGCTGACCTCCAAGGAATTGATGATGACTACTATAGGAATTGTACT
 L  L  A  A  F  K  V  R  P  T  F  A  A  G  L  L  L  R  K  L  T  S  K  E  L  M  M  T  T  I  G  I  V  L 3810       3820       3830       3840       3850       3860       3870       3880       3890       3900
CCTCTCCCAGAGCACCATACCAGAGACCATTCTTGAGTTGACTGATGCGTTAGCCTTAGGCATGATGGTCCTCAAAATGGTGAGAAATATGGAAAAGTAT
 L  S  Q  S  T  I  P  E  T  I  L  E  L  T  D  A  L  A  L  G  M  M  V  L  K  M  V  R  N  M  E  K  Y 3910       3920       3930       3940       3950       3960       3970       3980       3990       4000
CAATTGGCAGTGACTATCATGGCTATCTTGTGCGTCCCAAACGCAGTGATATTACAAAACGCATGGAAAGTGAGTTGCACAATATTGGCAGTGGTGTCCG
 Q  L  A  V  T  I  M  A  I  L  C  V  P  N  A  V  I  L  Q  N  A  W  K  V  S  C  T  I  L  A  V  V  S  V 4010       4020       4030       4040       4050       4060       4070       4080       4090       4100
TTTCCCCACTGTTCTTAACATCCTCACAGCAAAAAACAGATTGGATACCATTAGCATTGACGATCAAAGGTCTCAATCCAACAGCTATTTTTCTAACAAC
 S  P  L  F  L  T  S  S  Q  Q  K  T  D  W  I  P  L  A  L  T  I  K  G  L  N  P  T  A  I  F  L  T  T
          |
     D2 PDK-53 specific NS2A-181-Phe (wt D2 16681: Leu, nt-4012-C)
             > NS2B
      4110       4120       4130       4140       4150       4160       4170       4180       4190       4200
CCTCTCAAGAACCAGCAAGAAAGGAGCTGGCCATTAAATGAGGCTATCATGGCAGTCGGGATGGTGAGCATTTTAGCCAGTTCTCTCCTAAAAAATGAT
 L  S  R  T  S  K  K  R  S  W  P  L  N  E  A  I  M  A  V  G  M  V  S  I  L  A  S  S  L  L  K  N  D 4210       4220       4230       4240       4250       4260       4270       4280       4290       4300
ATTCCCATGACAGGACCATTAGTGGCTGGAGGGCTCCTCACTGTGTGCTACGTGCTCACTGGACGATCGGCCGATTTGGAACTGGAGAGAGCAGCCGATG
 I  P  M  T  G  P  L  V  A  G  G  L  L  T  V  C  Y  V  L  T  G  R  S  A  D  L  E  L  E  R  A  A  D  V 4310       4320       4330       4340       4350       4360       4370       4380       4390       4400
TCAAATGGGAAGACCAGGCAGAGATATCAGGAAGCAGTCCAATCCTGTCAATAACAATATCAGAAGATGGTAGCATGTCGATAAAAAATGAAGAGGAAGA
 K  W  E  D  Q  A  E  I  S  G  S  S  P  I  L  S  I  T  I  S  E  D  G  S  M  S  I  K  N  E  E  E  E
```

```
       4410      4420      4430      4440      4450      4460      4470      4480      4490      4500
ACAAACACTGACCATACTCATTAGAACAGGATTGCTGGTGATCTCAGGACTTTTTCCTGTATCAATACCAATCACGGCAGCAGCATGGTACCTGTGGGAA
 Q   T   L   T   I   L   I   R   T   G   L   L   V   I   S   G   L   F   P   V   S   I   P   I   T   A   A   A   W   Y   L   W   E

> NS3
       4510      4520      4530      4540      4550      4560      4570      4580      4590      4600
GTGAAGAAACAACGGGCCGGAGTATTGTGGGATGTTCCTTCACCCCCACCCATGGGAAAGGCTGAACTGGAAGATGGAGCCTATAGAATTAAGCAAAAG
 V   K   K   Q   R   A   G   V   L   W   D   V   P   S   P   P   P   M   G   K   A   E   L   E   D   G   A   Y   R   I   K   Q   K   G 4610      4620      4630      4640      4650      4660      4670      4680      4690      4700
GGATTCTTGGATATTCCCAGATCGGAGCCGGAGTTTACAAAGAAGGAACATTCCATACAATGTGGCATGTCACACGTGGCGCTGTTCTAATGCATAAAGG
   I   L   G   Y   S   Q   I   G   A   G   V   Y   K   E   G   T   F   H   T   M   W   H   V   T   R   G   A   V   L   M   H   K   G 4710      4720      4730      4740      4750      4760      4770      4780      4790      4800
AAAGAGGATTGAACCATCATGGGCGGACGTCAAGAAAGACCTAATATCATATGGAGGAGGCTGGAAGTTAGAAGGAGAATGGAAGGAAGGAGAAGAAGTC
 K   R   I   E   P   S   W   A   D   V   K   K   D   L   I   S   Y   G   G   G   W   K   L   E   G   E   W   K   E   G   E   E   V 4810      4820      4830      4840      4850      4860      4870      4880      4890      4900
CAGGTATTGGCACTGGAGCCTGGAAAAAATCCAAGAGCCGTCCAAACGAAACCTGGTCTTTTCAAAACCAACGCCGGAACAATAGGTGCTGTATCTCTGG
 Q   V   L   A   L   E   P   G   K   N   P   R   A   V   Q   T   K   P   G   L   F   K   T   N   A   G   T   I   G   A   V   S   L   D 4910      4920      4930      4940      4950      4960      4970      4980      4990      5000
ACTTTTCTCCTGGAACGTCAGGATCTCCAATTATCGACAAAAAGGGAAAAGTTGTGGGTCTTTATGGTAATGGTGTTGTTACAAGGAGTGGAGCATATGT
   F   S   P   G   T   S   G   S   P   I   I   D   K   K   G   K   V   V   G   L   Y   G   N   G   V   V   T   R   S   G   A   Y   V 5010      5020      5030      5040      5050      5060      5070      5080      5090      5100
GAGTGCTATAGCCCAGACTGAAAAAAGCATTGAAGACAACCCAGAGATCGAAGATGACATTTTCCGAAAGAGAAGACTGACCATCATGGACCTCCACCCA
 S   A   I   A   Q   T   E   K   S   I   E   D   N   P   E   I   E   D   D   I   F   R   K   R   R   L   T   I   M   D   L   H   P 5110      5120      5130      5140      5150      5160      5170      5180      5190      5200
GGAGCGGGAAAGACGAAGAGATACCTTCCGGCCATAGTCAGAGAAGCTATAAAACGGGGTTTGAGAACATTAATCTTGGCCCCCACTAGAGTTGTGGCAG
 G   A   G   K   T   K   R   Y   L   P   A   I   V   R   E   A   I   K   R   G   L   R   T   L   I   L   A   P   T   R   V   V   A   A 5210      5220      5230      5240      5250      5260      5270      5280      5290      5300
CTGAAATGGAGGAAGCCCTTAGAGGACTTCCAATAAGATACCAGACCCCAGCCATCAGAGCTGTGCACACCGGGCGGGAGATTGTGGACCTAATGTGTCA
   E   M   E   E   A   L   R   G   L   P   I   R   Y   Q   T   P   A   I   R   A   V   H   T   G   R   E   I   V   D   L   M   C   H
                                                                           |
                                            D2 PDK-53 NS3-250-Val attenuation locus (D2 16681: Glu, nt-5270-A)
       5310      5320      5330      5340      5350      5360      5370      5380      5390      5400
TGCCACATTTACCATGAGGCTGCTATCACCAGTTAGAGTGCCAAACTACAACCTGATTATCATGGACGAAGCCCATTTCACAGACCCAGCAAGTATAGCA
 A   T   F   T   M   R   L   L   S   P   V   R   V   P   N   Y   N   L   I   I   M   D   E   A   H   F   T   D   P   A   S   I   A 5410      5420      5430      5440      5450      5460      5470      5480      5490      5500
GCTAGAGGATACATCTCAACTCGAGTGGAGATGGGTGAGGCAGCTGGGATTTTTATGACAGCCACTCCCCCGGGAAGCAGAGACCCATTTCCTCAGAGCA
 A   R   G   Y   I   S   T   R   V   E   M   G   E   A   A   G   I   F   M   T   A   T   P   P   G   S   R   D   P   F   P   Q   S   N 5510      5520      5530      5540      5550      5560      5570      5580      5590      5600
ATGCACCAATCATAGATGAAGAAAGAGAAATCCCTGAACGCTCGTGGAATTCCGGACATGAATGGGTCACGGATTTTAAAGGGAAGACTGTTTGGTTCGT
   A   P   I   I   D   E   E   R   E   I   P   E   R   S   W   N   S   G   H   E   W   V   T   D   F   K   G   K   T   V   W   F   V
                                          |
                             D2 PDK-53 silent mutation nt-5541-C (D2 16681: T)
       5610      5620      5630      5640      5650      5660      5670      5680      5690      5700
TCCAAGTATAAAAGCAGGAAATGATATAGCAGCTTGCCTGAGGAAAAATGGAAAGAAAGTGATACAACTCAGTAGGAAGACCTTTGATTCTGAGTATGTC
 P   S   I   K   A   G   N   D   I   A   A   C   L   R   K   N   G   K   K   V   I   Q   L   S   R   K   T   F   D   S   E   Y   V 5710      5720      5730      5740      5750      5760      5770      5780      5790      5800
AAGACTAGAACCAATGATTGGGACTTCGTGGTTACAACTGACATTTCAGAAATGGGTGCCAATTTCAAGGCTGAGAGGGTTATAGACCCCAGACGCTGCA
 K   T   R   T   N   D   W   D   F   V   V   T   T   D   I   S   E   M   G   A   N   F   K   A   E   R   V   I   D   P   R   R   C   M 5810      5820      5830      5840      5850      5860      5870      5880      5890      5900
TGAAACCAGTCATACTAACAGATGGTGAAGAGCGGGTGATTCTGGCAGGACCTATGCCAGTGACCCACTCTAGTGCAGCACAAAGAAGAGGGAGAATAGG
   K   P   V   I   L   T   D   G   E   E   R   V   I   L   A   G   P   M   P   V   T   H   S   S   A   A   Q   R   R   G   R   I   G 5910      5920      5930      5940      5950      5960      5970      5980      5990      6000
AAGAAATCCAAAAAATGAGAATGACCAGTACATATACATGGGGGAACCTCTGGAAAATGATGAAGACTGTGCACACTGGAAAGAAGCTAAAATGCTCCTA
 R   N   P   K   N   E   N   D   Q   Y   I   Y   M   G   E   P   L   E   N   D   E   D   C   A   H   W   K   E   A   K   M   L   L 6010      6020      6030      6040      6050      6060      6070      6080      6090      6100
GATAACATCAACACGCCAGAAGGAATCATTCCTAGCATGTTCGAACCAGAGCGTGAAAAGGTGGATGCCATTGATGGCGAATACCGCTTGAGAGGAGAAG
 D   N   I   N   T   P   E   G   I   I   P   S   M   F   E   P   E   R   E   K   V   D   A   I   D   G   E   Y   R   L   R   G   E   A 6110      6120      6130      6140      6150      6160      6170      6180      6190      6200
CAAGGAAAACCTTTGTAGACTTAATGAGAAGAGGAGACCTACCAGTCTGGTTGGCCTACAGAGTGGCAGCTGAAGGCATCAACTACGCAGACAGAAGGTG
 R   K   T   F   V   D   L   M   R   R   G   D   L   P   V   W   L   A   Y   R   V   A   A   E   G   I   N   Y   A   D   R   R   W
```

```
      6210      6220      6230      6240      6250      6260      6270      6280      6290      6300
GTGTTTTGATGGAGTCAAGAACAACCAAATCCTAGAAGAAAACGTGGAAGTTGAAATCTGGACAAAAGAAGGGGAAAGGAAGAAATTGAAACCCAGATGG
 C  F  D  G  V  K  N  N  Q  I  L  E  E  N  V  E  V  E  I  W  T  K  E  G  E  R  K  K  L  K  P  R  W
                                                                             > NS4A
      6310      6320      6330      6340      6350      6360      6370      6380      6390      6400
TTGGATGCTAGGATCTATTCTGACCCACTGGCGCTAAAAGAATTTAAGGAATTTGCAGCCGGAAGAAAGTCTCTGACCCTGAACCTAATCACAGAAATGG
 L  D  A  R  I  Y  S  D  P  L  A  L  K  E  F  K  E  F  A  A  G  R  K  S  L  T  L  N  L  I  T  E  M  G 6410      6420      6430      6440      6450      6460      6470      6480      6490      6500
GTAGGCTCCCAACCTTCATGACTCAGAAGGCAAGAGACGCACTGGACAACTTAGCAGTGCTGCACACGGCTGAGGCAGGTGGAAGGGCGTACAACCATGC
  R  L  P  T  F  M  T  Q  K  A  R  D  A  L  D  N  L  A  V  L  H  T  A  E  A  G  G  R  A  Y  N  H  A 6510      6520      6530      6540      6550      6560      6570      6580      6590      6600
TCTCAGTGAACTGCCGGAGACCCTGGAGACATTGCTTTTACTGACACTTCTGGCTACAGTCACGGGAGGGATCTTTTTATTCTTGATGAGCGCAAGGGGC
  L  S  E  L  P  E  T  L  E  T  L  L  L  L  T  L  L  A  T  V  T  G  G  I  F  L  F  L  M  S  A  R  G
                                                                                              |
                                D2 PDK-53 specific NS4A-75-Ala (wt D2 16681: Gly, nt-6599-G)
      6610      6620      6630      6640      6650      6660      6670      6680      6690      6700
ATAGGGAAGATGACCCTGGGAATGTGCTGCATAATCACGGCTAGCATCCTCCTATGGTACGCACAAATACAGCCACACTGGATAGCAGCTTCAATAATAC
  I  G  K  M  T  L  G  M  C  C  I  I  T  A  S  I  L  L  W  Y  A  Q  I  Q  P  H  W  I  A  A  S  I  I  L 6710      6720      6730      6740      6750      6760      6770      6780      6790      6800
TGGAGTTTTTTCTCATAGTTTTGCTTATTCCAGAACCTGAAAAACAGAGAACACCCCAAGACAACCAACTGACCTACGTTGTCATAGCCATCCTCACAGT
  E  F  F  L  I  V  L  L  I  P  E  P  E  K  Q  R  T  P  Q  D  N  Q  L  T  Y  V  V  I  A  I  L  T  V
              > NS4B
      6810      6820      6830      6840      6850      6860      6870      6880      6890      6900
GGTGGCCGCAACCATGGCAAACGAGATGGGTTTCCTAGAAAAAACGAAGAAAGATCTCGGATTGGGAAGCATTGCAACCCAGCAACCCGAGAGCAACATC
  V  A  A  T  M  A  N  E  M  G  F  L  E  K  T  K  K  D  L  G  L  G  S  I  A  T  Q  Q  P  E  S  N  I 6910      6920      6930      6940      6950      6960      6970      6980      6990      7000
CTGGACATAGATCTACGTCCTGCATCAGCATGGACGCTGTATGCCGTGGCCACAACATTTGTTACACCAATGTTGAGACATAGCATTGAAAATTCCTCAG
  L  D  I  D  L  R  P  A  S  A  W  T  L  Y  A  V  A  T  T  F  V  T  P  M  L  R  H  S  I  E  N  S  S  V 7010      7020      7030      7040      7050      7060      7070      7080      7090      7100
TGAATGTGTCCCTAACAGCTATAGCCAACCAAGCCACAGTGTTAATGGGTCTCGGGAAAGGATGGCCATTGTCAAAGATGGACATCGGAGTTCCCCTTCT
  N  V  S  L  T  A  I  A  N  Q  A  T  V  L  M  G  L  G  K  G  W  P  L  S  K  M  D  I  G  V  P  L  L 7110      7120      7130      7140      7150      7160      7170      7180      7190      7200
CGCCATTGGATGCTACTCACAAGTCAACCCCATAACTCTCACAGCAGCTCTTTTCTTATTGGTAGCACATTATGCCATCATAGGGCCAGGACTCCAAGCA
  A  I  G  C  Y  S  Q  V  N  P  I  T  L  T  A  A  L  F  L  L  V  A  H  Y  A  I  I  G  P  G  L  Q  A 7210      7220      7230      7240      7250      7260      7270      7280      7290      7300
AAAGCAACCAGAGAAGCTCAGAAAAGAGCAGCGGCGGGCATCATGAAAAACCCAACTGTCGATGGAATAACAGTGATTGACCTAGATCCAATACCTTATG
  K  A  T  R  E  A  Q  K  R  A  A  A  G  I  M  K  N  P  T  V  D  G  I  T  V  I  D  L  D  P  I  P  Y  D 7310      7320      7330      7340      7350      7360      7370      7380      7390      7400
ATCCAAAGTTTGAAAAGCAGTTGGGACAAGTAATGCTCCTAGTCCTCTGCGTGACTCAAGTATTGATGATGAGGACTACATGGGCTCTGTGTGAGGCTTT
  P  K  F  E  K  Q  L  G  Q  V  M  L  L  V  L  C  V  T  Q  V  L  M  M  R  T  T  W  A  L  C  E  A  L 7410      7420      7430      7440      7450      7460      7470      7480      7490      7500
AACCCTTAGCTACCGGGCCCATCTCCACATTGTGGGAAGGAAATCCAGGGAGGTTTTGGAACACTACCATTGCGGTGTCAATGGCTAACATTTTTAGAGGG
  T  L  A  T  G  P  I  S  T  L  W  E  G  N  P  G  R  F  W  N  T  T  I  A  V  S  M  A  N  I  F  R  G
                                                         > NS5
      7510      7520      7530      7540      7550      7560      7570      7580      7590      7600
AGTTACTTGGCCGGAGCTGGACTTCTCTTTTCTATTATGAAGAACACAACCAACACAAGAAGGGGAACTGGCAACATAGGAGAGACGCTTGGAGAGAAAT
  S  Y  L  A  G  A  G  L  L  F  S  I  M  K  N  T  T  N  T  R  R  G  T  G  N  I  G  E  T  L  G  E  K  W 7610      7620      7630      7640      7650      7660      7670      7680      7690      7700
GGAAAAGCCGATTGAACGCGTTGGGAAAAAGTGAATTCCAGATCTACAAGAAAAGTGGAATCCAGGAAGTGGATAGAACCTTAGCAAAAGAAGGCATTAA
   K  S  R  L  N  A  L  G  K  S  E  F  Q  I  Y  K  K  S  G  I  Q  E  V  D  R  T  L  A  K  E  G  I  K
                                                      |
                    Additional nt-7260 A-to-G silent mutation in master and pre-master seeds
      7710      7720      7730      7740      7750      7760      7770      7780      7790      7800
AAGAGGAGAAACGGACCATCACGCTGTGTCGCGAGGCTCAGCAAAACTGAGATGGTTCGTTGAGAGAAACATGGTCACACCAGAAGGGAAAGTAGTGGAC
  R  G  E  T  D  H  H  A  V  S  R  G  S  A  K  L  R  W  F  V  E  R  N  M  V  T  P  E  G  K  V  V  D 7810      7820      7830      7840      7850      7860      7870      7880      7890      7900
CTCGGTTGTGGCAGAGGAGGCTGGTCATACTATTGTGGAGGACTAAAGAATGTAAGAGAAGTCAAAGGCCTAACAAAAGGAGGACCAGGACACGAAGAAC
  L  G  C  G  R  G  G  W  S  Y  Y  C  G  G  L  K  N  V  R  E  V  K  G  L  T  K  G  G  P  G  H  E  E  P 7910      7920      7930      7940      7950      7960      7970      7980      7990      8000
CCATCCCCATGTCAACATATGGGTGGAATCTAGTGCGTCTTCAAAGTGGAGTTGACGTTTTCTTCATCCCGCCAGAAAAGTGTGACACATTATTGTGTGA
  I  P  M  S  T  Y  G  W  N  L  V  R  L  Q  S  G  V  D  V  F  P  I  P  P  E  K  C  D  T  L  L  C  D
```

```
       8010      8020      8030      8040      8050      8060      8070      8080      8090      8100
CATAGGGGAGTCATCACCAAATCCCACAGTGGAAGCAGGACGAACACTCAGAGTCCTTAACTTAGTAGAAAATTGGTTGAACAACAACACTCAATTTTGC
  I  G  E  S  S  P  N  P  T  V  E  A  G  R  T  L  R  V  L  N  L  V  E  N  W  L  N  N  N  T  Q  F  C 8110      8120      8130      8140      8150      8160      8170      8180      8190      8200
ATAAAGGTTCTCAACCCATATATGCCCTCAGTCATAGAAAAAATGGAAGCACTACAAAGGAAATATGGAGGAGCCTTAGTGAGGAATCCACTCTCACGAA
  I  K  V  L  N  P  Y  M  P  S  V  I  E  K  M  E  A  L  Q  R  K  Y  G  G  A  L  V  R  N  P  L  S  R  N 8210      8220      8230      8240      8250      8260      8270      8280      8290      8300
ACTCCACACATGAGATGTACTGGGTATCCAATGCTTCCGGGAACATAGTGTCATCAGTGAACATGATTTCAAGGATGTTGATAACAGATTTACAATGAG
  S  T  H  E  M  Y  W  V  S  N  A  S  G  N  I  V  S  S  V  N  M  I  S  R  M  L  I  N  R  F  T  M  R 8310      8320      8330      8340      8350      8360      8370      8380      8390      8400
ATACAAGAAAGCCACTTACGAGCCGGATGTTGACCTCGGAAGCGGAACCCGTAACATCGGGATTGAAAGTGAGATACCAAACCTAGATATAATTGGGAAA
  Y  K  K  A  T  Y  E  P  D  V  D  L  G  S  G  T  R  N  I  G  I  E  S  E  I  P  N  L  D  I  I  G  K 8410      8420      8430      8440      8450      8460      8470      8480      8490      8500
AGAATAGAAAAAATAAAGCAAGAGCATGAAACATCATGGCACTATGACCAAGACCACCCATACAAAACGTGGGCATACCATGGTAGCTATGAAACAAAAC
  R  I  E  K  I  K  Q  E  H  E  T  S  W  H  Y  D  Q  D  H  P  Y  K  T  W  A  Y  H  G  S  Y  E  T  K  Q 8510      8520      8530      8540      8550      8560      8570      8580      8590      8600
AGACTGGATCAGCATCATCCATGGTCAACGGAGTGGTCAGGCTGCTGACAAAACCTTGGGACGTCGTCCCCATGGTGACACAGATGGCAATGACAGACAC
  T  G  S  A  S  S  M  V  N  G  V  V  R  L  L  T  K  P  W  D  V  V  P  M  V  T  Q  M  A  M  T  D  T 8610      8620      8630      8640      8650      8660      8670      8680      8690      8700
GACTCCATTTGGACAACAGCGCGTTTTTAAAGAGAAAGTGGACACGAGAACCCAAGAACCGAAAGAAGGCACGAAGAAACTAATGAAAATAACAGCAGAG
  T  P  F  G  Q  Q  R  V  F  K  E  K  V  D  T  R  T  Q  E  P  K  E  G  T  K  K  L  M  K  I  T  A  E 8710      8720      8730      8740      8750      8760      8770      8780      8790      8800
TGGCTTTGGAAAGAATTAGGGAAGAAAAAGACACCCAGGATGTGCACCAGAGAAGAATTCACAAGAAAGGTGAGAAGCAATGCAGCCTTGGGGGCCATAT
  W  L  W  K  E  L  G  K  K  K  T  P  R  M  C  T  R  E  E  F  T  R  K  V  R  S  N  A  A  L  G  A  I  F 8810      8820      8830      8840      8850      8860      8870      8880      8890      8900
TCACTGATGAGAACAAGTGGAAGTCGGCACGTGAGGCTGTTGAAGATAGTAGGTTTTGGGAGCTGGTTGACAAGGAAAGGAATCTCCATCTTGAAGGAAA
  T  D  E  N  K  W  K  S  A  R  E  A  V  E  D  S  R  F  W  E  L  V  D  K  E  R  N  L  H  L  E  G  K 8910      8920      8930      8940      8950      8960      8970      8980      8990      9000
GTGTGAAACATGTGTGTACAACATGATGGGAAAAAGAGAAGAAGCTAGGGGAATTCGGCAAGGCAAAAGGCAGCAGAGCCATATGGTACATGTGGCTT
  C  E  T  C  V  Y  N  M  M  G  K  R  E  K  K  L  G  E  F  G  K  A  K  G  S  R  A  I  W  Y  M  W  L 9010      9020      9030      9040      9050      9060      9070      9080      9090      9100
GGAGCACGCTTCTTAGAGTTTGAAGCCCTAGGATTCTTAAATGAAGATCACTGGTTCTCCAGAGAGAACTCCCTGAGTGGAGTGGAAGGAGAAGGGCTGC
  G  A  R  F  L  E  F  E  A  L  G  F  L  N  E  D  H  W  F  S  R  E  N  S  L  S  G  V  E  G  E  G  L  H 9110      9120      9130      9140      9150      9160      9170      9180      9190      9200
ACAAGCTAGGTTACATTCTAAGAGACGTGAGCAAGAAAGAGGGAGGAGCAATGTATGCCGATGACACCGCAGGATGGGATACAAGAATCACACTAGAAGA
  K  L  G  Y  I  L  R  D  V  S  K  K  E  G  G  A  M  Y  A  D  D  T  A  G  W  D  T  R  I  T  L  E  D 9210      9220      9230      9240      9250      9260      9270      9280      9290      9300
CCTAAAAAATGAAGAAATGGTAACAAACCACATGGAAGGAGAACACAAGAAACTAGCCGAGGCCATTTTCAAACTAACGTACCAAAACAAGGTGGTGCGT
  L  K  N  E  E  M  V  T  N  H  M  E  G  E  H  K  K  L  A  E  A  I  F  K  L  T  Y  Q  N  K  V  V  R 9310      9320      9330      9340      9350      9360      9370      9380      9390      9400
GTGCAAAGACCAACACCAAGAGGCACAGTAATGGACATCATATCGAGAAGAGACCAAAGAGGTAGTGGACAAGTTGGCACCTATGGACTCAATACTTTCA
  V  Q  R  P  T  P  R  G  T  V  M  D  I  I  S  R  R  D  Q  R  G  S  G  Q  V  G  T  Y  G  L  N  T  F  T 9410      9420      9430      9440      9450      9460      9470      9480      9490      9500
CCAATATGGAAGCCCAACTAATCAGACAGATGGAGGGAGAAGGAGTCTTTAAAAGCATTCAGCACCTAACAATCACAGAAGAAATCGCTGTGCAAAACTG
  N  M  E  A  Q  L  I  R  Q  M  E  G  E  G  V  F  K  S  I  Q  H  L  T  I  T  E  E  I  A  V  Q  N  W 9510      9520      9530      9540      9550      9560      9570      9580      9590      9600
GTTAGCAAGAGTGGGGCGCGAAAGGTTATCAAGAATGGCCATCAGTGGAGATGATTGTGTTGTGAAACCTTTAGATGACAGGTTCGCAAGCGCTTTAACA
  L  A  R  V  G  R  E  R  L  S  R  M  A  I  S  G  D  D  C  V  V  K  P  L  D  D  R  F  A  S  A  L  T 9610      9620      9630      9640      9650      9660      9670      9680      9690      9700
GCTCTAAATGACATGGGAAAGATTAGGAAAGACATACAACAATGGGAACCTTCAAGAGGATGGAATGATTGGACACAAGTGCCCTTCTGTTCACACCATT
  A  L  N  D  M  G  K  I  R  K  D  I  Q  Q  W  E  P  S  R  G  W  N  D  W  T  Q  V  P  F  C  S  H  H  F 9710      9720      9730      9740      9750      9760      9770      9780      9790      9800
TCCATGAGTTAATCATGAAAGACGGTCGCGTACTCGTTGTTCCATGTAGAAACCAAGATGAACTGATTGGCAGAGCCCGAATCTCCCAAGGAGCAGGGTG
  H  E  L  I  M  K  D  G  R  V  L  V  V  P  C  R  N  Q  D  E  L  I  G  R  A  R  I  S  Q  G  A  G  W 9810      9820      9830      9840      9850      9860      9870      9880      9890      9900
GTCTTTGCGGGAGACGGCCTGTTTGGGGAAGTCTTACGCCCAAATGTGGAGCTTGATGTACTTCCACAGACGCGACCTCAGGCTGGCGGCAAATGCTATT
  S  L  R  E  T  A  C  L  G  K  S  Y  A  Q  M  W  S  L  M  Y  F  H  R  R  D  L  R  L  A  A  N  A  I
```

```
       9910      9920      9930      9940      9950      9960      9970      9980      9990     10000
TGCTCGGCAGTACCATCACATTGGGTTCCAACAAGTCGAACAACCTGGTCCATACATGCTAAACATGAATGGATGACAACGGAAGACATGCTGACAGTCT
 C   S   A   V   P   S   H   W   V   P   T   S   R   T   T   W   S   I   H   A   K   H   E   W   M   T   T   E   D   M   L   T   V   W 10010     10020     10030     10040     10050     10060     10070     10080     10090     10100
GGAACAGGGTGTGGATTCAAGAAAACCCATGGATGGAAGACAAAACTCCAGTGGAATCATGGGAGGAAATCCCATACTTGGGGAAAAGAGAAGACCAATG
   N   R   V   W   I   Q   E   N   P   W   M   E   D   K   T   P   V   E   S   W   E   E   I   P   Y   L   G   K   R   E   D   Q   W 10110     10120     10130     10140     10150     10160     10170     10180     10190     10200
GTGCGGCTCATTGATTGGGTTAACAAGCAGGGCCACCTGGGCAAAGAACATCCAAGCAGCAATAAATCAAGTTAGATCCCTTATAGGCAATGAAGAATAC
 C   G   S   L   I   G   L   T   S   R   A   T   W   A   K   N   I   Q   A   A   I   N   Q   V   R   S   L   I   G   N   E   E   Y

> 3'-Noncoding Region
      10210     10220     10230     10240     10250     10260     10270     10280     10290     10300
ACAGATTACATGCCATCCATGAAAAGATTCAGAAGAGAAGAGGAAGAAGCAGGAGTTCTGTGGTAGAAAGCAAAACTAACATGAAACAAGGCTAGAAGTC
 T   D   Y   M   P   S   M   K   R   F   R   R   E   E   E   E   A   G   V   L   W   *

10310     10320     10330     10340     10350     10360     10370     10380     10390     10400
AGGTCGGATTAAGCCATAGTACGGAAAAAACTATGCTACCTGTGAGCCCCGTCCAAGGACGTTAAAAGAAGTCAGGCCATCATAAATGCCATAGCTTGAG 10410     10420     10430     10440     10450     10460     10470     10480     10490     10500
TAAACTATGCAGCCTGTAGCTCCACCTGAGAAGGTGTAAAAAATCCGGGAGGCCACAAACCATGGAAGCTGTACGCATGGCGTAGTGGACTAGCGGTTAG 10510     10520     10530     10540     10550     10560     10570     10580     10590     10600
AGGAGACCCCTCCCTTACAAATCGCAGCAACAATGGGGGCCCAAGGCGAGATGAAGCTGTAGTCTCGCTGGAAGGACTAGAGGTTAGAGGAGACCCCCCC 10610     10620     10630     10640     10650     10660     10670     10680     10690     10700
GAAACAAAAAACAGCATATTGACGCTGGGAAAGACCAGAGATCCTGCTGTCTCCTCAGCATCATTCCAGGCACAGAACGCCAGAAAATGGAATGGTGCTG

10710
TTGAATCAACAGGTTCT
```

DENvax-4 Master Virus Seed (MVS)

Nucleotide sequence of the chimeric viral genome and deduced amino acid sequence of the translated protein. Most of the prM-E gene (nt-457 to -2379, underlined) is wild-type (wt) DEN-4 1036 virus-specific; the remaining nucleotide sequence is DEN-2 PDK-53 virus-specific. All engineered substitutions differ from wt virus (DEN-3 16562 or DEN-2 16681), as well as extra mutations (changes from engineered cDNA clone) are marked.

Substitutions Included in the Genome and Protein:
  Junction sites:
    a. MluI (nt 451-456): engineered silent mutation, nt-453 A-to-G
    b. NgoMIV (nt 2380-2385): engineered mutations, nt-2381/2382 TG-to-CC (resulted in E-482 Val-to-Ala change)
  D2 PDK-53 virus backbone (change from wt D2 16681)
    a. 5'-noncoding region (NCR)-57 (nt-57 C-to-T): major attenuation locus (in red)
    b. NS1-53 Gly-to-Asp (nt-2579 G-to-A): major attenuation locus (in red)
    c. NS2A-181 Leu-to-Phe (nt-4018 C-to-T, in bold)
    d. NS3-250 Glu-to-Val (nt-5270 A-to-T): major attenuation locus (in red)
    e. nt-5547 (NS3 gene) T-to-C silent mutation (in bold)
    f. NS4A-75 Gly-to-Ala (nt-6599 G-to-C, in bold)
    nt-8571 C-to-T silent mutation of PDK-53 is not engineered in the vaccine virus
  Engineered substitutions in cDNA clone
    a. Engineered C-100 Arg-to-Ser (nt-396 A-to-C): may improve viral replication in culture
    b. Engineered nt-1401 A-to-G silent mutation
    c. Engineered E-364 Ala-to-Val (nt-2027 C-to-T): may improve viral replication in culture
    d. Engineered E-447 Met-to-Leu (nt-2275 A-to-C): may improve viral replication in culture
  Additional substitutions found in vaccine seed (0.06% nt different from original clone)
    a. nt-225 (C gene) A-to-T silent mutation (in bold)
    b. NS2A-66 Asp-to-Gly (nt-3674 A-to-G) mutation (in bold)
    c. NS2A-99 Lys-to-Lys/Arg mix (nt-3773 A-to-A/G mix, in bold)
    d. nt-5391 C-to-T (NS3 gene) silent mutation (in bold)
    e. NS4A-21 Ala-to-Val (nt-6437 C-to-T, in bold)
    f. nt-7026 T-to-C/T mix silent mutation (in bold)
    g. nt-9750 A-to-C silent mutation (in bold)

```
                                                   NCR-57-T, D2 PDK-53 attenuation locus (wt D2 16681: C)
> 5'-Noncoding Region                                                   |                                                       >C
        10        20        30        40        50        60        70        80        90       100
AGTTGTTAGTCTACGTGGACCGACAAAGACAGATTCTTTGAGGGAGCTAAGCTCAATGTAGTTCTAACAGTTTTTTAATTAGAGAGCAGATCTCTGATGA
                                                                                                 M   N 110       120       130       140       150       160       170       180       190       200
ATAACCAACGGAAAAAGGCGAAAAACACGCCTTTCAATATGCTGAAACGCGAGAGAAACCGCGTGTCGACTGTGCAACAGCTGACAAAGAGATTCTCACT
  N   Q   R   K   K   A   K   N   T   P   F   N   M   L   K   R   E   R   N   R   V   S   T   V   Q   Q   L   T   K   R   F   S   L
```

```
     210       220       230       240       250       260       270       280       290       300
TGGAATGCTGCAGGGACGAGGACCTTTAAAACTGTTCATGGCCCTGGTGGCGTTCCTTCGTTTCCTAACAATCCCACCAACAGCAGGGATATTGAAGAGA
 G  M  L  Q  G  R  G  P  L  K  L  F  M  A  L  V  A  F  L  R  F  L  T  I  P  P  T  A  G  I  L  K  R
                        |
                        Additional nt-225 A-to-T silent mutation in master and pre-master seeds 310       320       330       340       350       360       370       380       390       400
TGGGGAACAATTAAAAAATCAAAAGCTATTAATGTTTTGAGAGGGTTCAGGAAAGAGATTGGAAGGATGCTGAACATCTTGAATAGGAGACGCAGCTCTG
 W  G  T  I  K  K  S  K  A  I  N  V  L  R  G  F  R  K  E  I  G  R  M  L  N  I  L  N  R  R  R  S  A
                                                                                              |
                                                                    Engineered C-100 Arg-to-Ser (nt 396 A-to-C)

> prM         Beginning of D4 1036 sequence
     410       420       430       440       450 |460       470       480       490       500
CAGGCATGATCATTATGCTGATTCCAACAGTGATGGCGTTCCATTTAACCACGCGTGATGGCGAACCCCTCATGATAGTGGCAAAACATGAAGGGGAG
 Q  G  M  I  I  M  L  I  P  T  V  M  A  F  H  L  T  T  R  D  G  E  P  L  M  I  V  A  K  H  E  R  G  R
                                                 |
                                                 Engineered MluI splicing site (nt-453 A-to-G silent)

510       520       530       540       550       560       570       580       590       600
ACCTCTCTTGTTTAAGACAACAGAGGGGATCAACAAATGCACTCTCATTGCCATGGACTTGGGTGAAATGTGTGAGGACACTGTCACGTATAAATGCCCC
 P  L  L  F  K  T  T  E  G  I  N  K  C  T  L  I  A  M  D  L  G  E  M  C  E  D  T  V  T  Y  K  C  P 610       620       630       640       650       660       670       680       690       700
TTACTGGTCAATACCGAACCTGAAGACATTGATTGCTGGTGCAATCTCACGTCTACCTGGGTCATGTATGGGACATGCACCCAGAGCGGAGAACGGAGAC
 L  L  V  N  T  E  P  E  D  I  D  C  W  C  N  L  T  S  T  W  V  M  Y  G  T  C  T  Q  S  G  E  R  R  R

> M
     710       720       730       740       750       760       770       780       790       800
GAGAGAAGCGCTCAGTAGCTTTAACACCACATTCAGGAATGGGATTGGAAACAAGAGCTGAGACATGGATGTCATCGGAAGGGGCTTGGAAGCATGCTCA
 E  K  R  S  V  A  L  T  P  H  S  G  M  G  L  E  T  R  A  E  T  W  M  S  S  E  G  A  W  K  H  A  Q 810       820       830       840       850       860       870       880       890       900
GAGAGTAGAGAGCTGGATACTCAGAAACCCAGGATTCGCGCTCTTGGCAGGATTTATGGCTTATATGATTGGGCAAACAGGAATCCAGCGAACTGTCTTC
 R  V  E  S  W  I  L  R  N  P  G  F  A  L  L  A  G  F  M  A  Y  M  I  G  Q  T  G  I  Q  R  T  V  F

> E
     910       920       930       940       950       960       970       980       990      1000
TTTGTCCTAATGATGCTGGTCGCCCCATCCTACGGAATGCGATGCGTAGGAGTAGGAAACAGAGACTTTGTGGAAGGAGTCTCAGGTGGAGCATGGGTCG
 F  V  L  M  M  L  V  A  P  S  Y  G  M  R  C  V  G  V  G  N  R  D  F  V  E  G  V  S  G  G  A  W  V  D 1010      1020      1030      1040      1050      1060      1070      1080      1090      1100
ATCTGGTGCTAGAACATGGAGGATGCGTCACAACCATGGCCCAGGGAAAACCAACCTTGGATTTTGAACTGACTAAGACAACAGCCAAGGAAGTGGCTCT
 L  V  L  E  H  G  G  C  V  T  T  M  A  Q  G  K  P  T  L  D  F  E  L  T  K  T  T  A  K  E  V  A  L 1110      1120      1130      1140      1150      1160      1170      1180      1190      1200
GTTAAGAACCTATTGCATTGAAGCCTCAATATCAAACATAACCACGGCAACAAGATGTCCAACGCAAGGAGAGCCTTATCTAAAAGAGGAACAAGACCAA
 L  R  T  Y  C  I  E  A  S  I  S  N  I  T  T  A  T  R  C  P  T  Q  G  E  P  Y  L  K  E  E  Q  D  Q 1210      1220      1230      1240      1250      1260      1270      1280      1290      1300
CAGTACATTTGCCGGAGAGATGTGGTAGACAGAGGGTGGGGCAATGGCTGTGGCTTGTTTGGAAAAGGAGGAGTTGTGACATGTGCGAAGTTTTCATGTT
 Q  Y  I  C  R  R  D  V  V  D  R  G  W  G  N  G  C  G  L  F  G  K  G  G  V  V  T  C  A  K  F  S  C  S 1310      1320      1330      1340      1350      1360      1370      1380      1390      1400
CGGGGAAGATAACAGGCAATTTGGTCCAAATTGAGAACCTTGAATACACAGTGGTTGTAACAGTCCACAATGGAGACACCCATGCAGTAGGAAATGACAC
 G  K  I  T  G  N  L  V  Q  I  E  N  L  E  Y  T  V  V  V  T  V  H  N  G  D  T  H  A  V  G  N  D  T 1410      1420      1430      1440      1450      1460      1470      1480      1490      1500
GTCCAATCATGGAGTTACAGCCACGATAACTCCCAGGTCACCATCGGTGGAAGTCAAATTGCCGGACTATGGAGAACTAACACTCGATTGTGAACCCAGG
 S  N  H  G  V  T  A  T  I  T  P  R  S  P  S  V  E  V  K  L  P  D  Y  G  E  L  T  L  D  C  E  P  R
 |
 Silent nt-1401 A-to-G mutation in engineered clone 1510      1520      1530      1540      1550      1560      1570      1580      1590      1600
TCTGGAATTGACTTTAATGAGATGATTCTGATGAAAATGAAAAAGAAACATGGCTTGTGCATAAGCAATGGTTTTTGGATCTACCTCTACCATGGACAG
 S  G  I  D  F  N  E  M  I  L  M  K  M  K  K  K  T  W  L  V  H  K  Q  W  F  L  D  L  P  W  T  A 1610      1620      1630      1640      1650      1660      1670      1680      1690      1700
CAGGAGCAGACACATCAGAGGTTCACTGGAATTACAAAGAGAGAATGGTGACATTTAAGGTTCCTCATGCCAAGAGACAGGATGTGACAGTGCTGGGATC
 G  A  D  T  S  E  V  H  W  N  Y  K  E  R  M  V  T  F  K  V  P  H  A  K  R  Q  D  V  T  V  L  G  S 1710      1720      1730      1740      1750      1760      1770      1780      1790      1800
TCAGGAAGGAGCCATGCATTCTGCCCTCGCTGGAGCCACAGAAGTGGACTCCGGTGATGGAAATCACATGTTTGCAGGACATCTCAAGTGCAAAGTCCGT
 Q  E  G  A  M  H  S  A  L  A  G  A  T  E  V  D  S  G  D  G  N  H  M  F  A  G  H  L  K  C  K  V  R 1810      1820      1830      1840      1850      1860      1870      1880      1890      1900
ATGGAGAAATTGAGAATCAAGGGAATGTCATACACGATGTGTTCAGGAAAGTTCTCAATTGACAAAGAGATGGCAGAAACACAGCATGGGACAACAGTGG
 M  E  K  L  R  I  K  G  M  S  Y  T  M  C  S  G  K  F  S  I  D  K  E  M  A  E  T  Q  H  G  T  T  V  V
```

```
          1910      1920      1930      1940      1950      1960      1970      1980      1990      2000
TGAAAGTCAAGTATGAAGGTGCTGGAGCTCCGTGTAAAGTCCCCATAGAGATAAGAGATGTGAACAAGGAAAAAGTGGTTGGGCGTATCATCTCATCCAC
  K  V  K  Y  E  G  A  G  A  P  C  K  V  P  I  E  I  R  D  V  N  K  E  K  V  V  G  R  I  I  S  S  T 2010      2020      2030      2040      2050      2060      2070      2080      2090      2100
CCCTTTGGCTGAGAATACCAACAGTGTAACCAACATAGAGTTAGAACCCCCTTTGGGGACAGCTACATAGTGATAGGTGTTGGAAACAGTGCATTAACA
  P  L  A  E  N  T  N  S  V  T  N  I  E  L  E  P  P  F  G  D  S  Y  I  V  I  G  V  G  N  S  A  L  T
                          |
                          Engineered E-364 Ala-to-Val (nt-2027 C-to-T) to improve viral growth in culture 2110      2120      2130      2140      2150      2160      2170      2180      2190      2200
CTCCATTGGTTCAGGAAAGGGAGTTCCATTGGCAAGATGTTTGAGTCCACATACAGAGGTGCAAAACGAATGGCCATTCTAGGTGAAACAGCTTGGGATT
  L  H  W  F  R  K  G  S  S  I  G  K  M  F  E  S  T  Y  R  G  A  K  R  M  A  I  L  G  E  T  A  W  D  F 2210      2220      2230      2240      2250      2260      2270      2280      2290      2300
TTGGTTCCGTTGGTGGACTGTTCACATCATTGGGAAAGGCTGTGCACCAGGTTTTTGGAAGTGTGTATACAACCCTGTTTGGAGGAGTCTCATGGATGAT
  G  S  V  G  G  L  F  T  S  L  G  K  A  V  H  Q  V  F  G  S  V  Y  T  T  L  F  G  G  V  S  W  M  I
                                                                        |
                                                                        Engineered E-447 Met-to-Leu (nt-2275 A-to-C) mutation End of D4 1036 sequence
          2310      2320      2330      2340      2350      2360      2370         |        2390      2400
TAGAATCCTAATTGGGTTCCTAGTGTTGTGGATTGGCACGAACTCAAGGAACACTTCAATGGCTATGACGTGCATAGCTGCCGGCATTGTGACACTGTAT
  R  I  L  I  G  F  L  V  L  W  I  G  T  N  S  R  N  T  S  M  A  M  T  C  I  A  A  G  I  V  T  L  Y
                                                                                      |
                       Engineered NgoMIV splicing site, E-482 Val-to-Ala (nt-2381/2382 TG-to-CC)

> NS1
          2410      2420      2430      2440      2450      2460      2470      2480      2490      2500
TTGGGGGTCATGGTGCAGGCCGATAGTGGTTGCGTTGTGAGCTGGAAAAACAAAGAACTGAAATGTGGCAGTGGGATTTTCATCACAGACAACGTGCACA
L  G  V  M  V  Q  A  D  S  G  C  V  V  S  W  K  N  K  E  L  K  C  G  S  G  I  F  I  T  D  N  V  H  T 2510      2520      2530      2540      2550      2560      2570      2580      2590      2600
CATGGACAGAACAATACAAGTTCCAACCAGAATCCCCTTCAAAACTAGCTTCAGCTATCCAGAAAGCCCATGAAGAGGACATTTGTGGAATCCGCTCAGT
  W  T  E  Q  Y  K  F  Q  P  E  S  P  S  K  L  A  S  A  I  Q  K  A  H  E  E  D  I  C  G  I  R  S  V
                                                                            |
                         D2 PDK-53 NS1-53-Asp attenuation locus (wt D2 16681: Gly, nt-2579-G)

2610      2620      2630      2640      2650      2660      2670      2680      2690      2700
AACAAGACTGGAGAATCTGATGTGGAAACAAATAACACCAGAATTGAATCACATTCTATCAGAAAATGAGGTGAAGTTAACTATTATGACAGGAGACATC
  T  R  L  E  N  L  M  W  K  Q  I  T  P  E  L  N  H  I  L  S  E  N  E  V  K  L  T  I  M  T  G  D  I 2710      2720      2730      2740      2750      2760      2770      2780      2790      2800
AAAGGAATCATGCAGGCAGGAAAACGATCTCTGCGGCCTCAGCCCACTGAGCTGAAGTATTCATGGAAAACATGGGGCAAAGCAAAAATGCTCTCTACAG
  K  G  I  M  Q  A  G  K  R  S  L  R  P  Q  P  T  E  L  K  Y  S  W  K  T  W  G  K  A  K  M  L  S  T  E 2810      2820      2830      2840      2850      2860      2870      2880      2890      2900
AGTCTCATAACCAGACCTTTCTCATTGATGGCCCCGAAACAGCAGAATGCCCCAACACAAATAGAGCTTGGAATTCGTTGGAAGTTGAAGACTATGGCTT
   S  H  N  Q  T  F  L  I  D  G  P  E  T  A  E  C  P  N  T  N  R  A  W  N  S  L  E  V  E  D  Y  G  F 2910      2920      2930      2940      2950      2960      2970      2980      2990      3000
TGGAGTATTCACCACCAATATATGGCTAAAATTGAAAGAAAAACAGGATGTATTCTGCGACTCAAAACTCATGTCAGCGGCCATAAAAGACAACAGAGCC
  G  V  F  T  T  N  I  W  L  K  L  K  E  K  Q  D  V  F  C  D  S  K  L  M  S  A  A  I  K  D  N  R  A 3010      3020      3030      3040      3050      3060      3070      3080      3090      3100
GTCCATGCCGATATGGGTTATTGGATAGAAAGTGCACTCAATGACACATGGAAGATAGAAAAGCCTCTTTCATTGAAGTTAAAAACTGCCACTGGCCAA
  V  H  A  D  M  G  Y  W  I  E  S  A  L  N  D  T  W  K  I  E  K  A  S  F  I  E  V  K  N  C  H  W  P  K 3110      3120      3130      3140      3150      3160      3170      3180      3190      3200
AATCACACACCCTCTGGAGCAATGGAGTGCTAGAAAGTGAGATGATAATTCCAAAGAATCTCGCTGGACCAGTGTCTCAACACAACTATAGACCAGGCTA
  S  H  T  L  W  S  N  G  V  L  E  S  E  M  I  I  P  K  N  L  A  G  P  V  S  Q  H  N  Y  R  P  G  Y 3210      3220      3230      3240      3250      3260      3270      3280      3290      3300
CCATACACAAATAACAGGACCATGGCATCTAGGTAAGCTTGAGATGGACTTTGATTTCTGTGATGGAACAACAGTGGTAGTGACTGAGGACTGCGGAAAT
  H  T  Q  I  T  G  P  W  H  L  G  K  L  E  M  D  F  D  F  C  D  G  T  T  V  V  V  T  E  D  C  G  N 3310      3320      3330      3340      3350      3360      3370      3380      3390      3400
AGAGGACCCTCTTTGAGAACAACCACTGCCTCTGGAAAACTCATAACAGAATGGTGCTGCCGATCTTGCACATTACCACCGCTAAGATACAGAGGTGAGG
  R  G  P  S  L  R  T  T  T  A  S  G  K  L  I  T  E  W  C  C  R  S  C  T  L  P  P  L  R  Y  R  G  E  D

> NS2A
          3410      3420      3430      3440      3450      3460      3470      3480      3490      3500
ATGGGTGCTGGTACGGGATGGAAATCAGACCATTGAAGGAGAAAGAAGAGAATTTGGTCAACTCCTTGGTCACAGCTGGACATGGGCAGGTCGACAACTT
  G  C  W  Y  G  M  E  I  R  P  L  K  E  K  E  E  N  L  V  N  S  L  V  T  A  G  H  G  Q  V  D  N  F 3510      3520      3530      3540      3550      3560      3570      3580      3590      3600
TTCACTAGGAGTCTTGGGAATGGCATTGTTCCTGGAGGAAATGCTTAGGACCCGAGTAGGAACGAAACATGCAATACTACTAGTTGCAGTTTCTTTTGTG
  S  L  G  V  L  G  M  A  L  F  L  E  E  M  L  R  T  R  V  G  T  K  H  A  I  L  L  V  A  V  S  F  V
```

```
             3610       3620       3630       3640       3650       3660       3670       3680       3690       3700
ACATTGATCACAGGGAACATGTCCTTTAGAGACCTGGGAAGAGTGATGGTTATGGTAGGCGCCACTATGACGGGTGACATAGGTATGGGCGTGACTTATC
  T  L  I  T  G  N  M  S  F  R  D  L  G  R  V  M  V  M  V  G  A  T  M  T  G  D  I  G  M  G  V  T  Y  L
                                                                                |
                  Additional NS2A-66 Asp-to-Gly (nt-3674 A-to-G mutation) in master and pre-master seeds 3710       3720       3730       3740       3750       3760       3770       3780       3790       3800
TTGCCCTACTAGCAGCCTTCAAAGTCAGACCAACTTTTGCAGCTGGACTACTCTTGAGAAAGCTGACCTCCAGGGAATTGATGATGACTACTATAGGAAT
   A  L  L  A  A  F  K  V  R  P  T  F  A  A  G  L  L  L  R  K  L  T  S  K  E  L  M  M  T  T  I  G  I
                                                                      |
                       Additional NS2A-99 K to R/K (mix) (nt-3773 A-to-G/A) mutation in master seed 3810       3820       3830       3840       3850       3860       3870       3880       3890       3900
TGTACTCCTCTCCCAGAGCACCATACCAGAGACCATTCTTGAGTTGACTGATGCGTTAGCCTTAGGCATGATGGTCCTCAAAATGGTGAGAAATATGGAA
  V  L  L  S  Q  S  T  I  P  E  T  I  L  E  L  T  D  A  L  A  L  G  M  M  V  L  K  M  V  R  N  M  E 3910       3920       3930       3940       3950       3960       3970       3980       3990       4000
AAGTATCAATTGGCAGTGACTATCATGGCTATCTTGTGCGTCCCAAACGCAGTGATATTACAAAACGCATGGAAAGTGAGTTGCACAATATTGGCAGTGG
  K  Y  Q  L  A  V  T  I  M  A  I  L  C  V  P  N  A  V  I  L  Q  N  A  W  K  V  S  C  T  I  L  A  V  V 4010       4020       4030       4040       4050       4060       4070       4080       4090       4100
TGTCCGTTTCCCCACTGTTCTTAACATCCTCACAGCAAAAAACAGATTGGATACCATTAGCATTGACGATCAAAGGTCTCAATCCAACAGCTATTTTTCT
     S  V  S  P  L  F  L  T  S  S  Q  Q  K  T  D  W  I  P  L  A  L  T  I  K  G  L  N  P  T  A  I  F  L
                    |
 D2 PDK-53 specific NS2A-181-Phe (wt D2 16681: Leu, nt-4018-C)

> NS2B
             4110       4120       4130       4140       4150       4160       4170       4180       4190       4200
AACAACCCTCTCAAGAACCAGCAAGAAAAGGAGCTGGCCATTAAATGAGGCTATCATGGCAGTCGGGATGGTGAGCATTTTAGCCAGTTCTCTCCTAAAA
  T  T  L  S  R  T  S  K  K  R  S  W  P  L  N  E  A  I  M  A  V  G  M  V  S  I  L  A  S  S  L  L  K 4210       4220       4230       4240       4250       4260       4270       4280       4290       4300
AATGATATTCCCATGACAGGACCATTAGTGGCTGGAGGGCTCCTCACTGTGTGCTACGTGCTCACTGGACGATCGGCCGATTTGGAACTGGAGAGAGCAG
  N  D  I  P  M  T  G  P  L  V  A  G  G  L  L  T  V  C  Y  V  L  T  G  R  S  A  D  L  E  L  E  R  A  A 4310       4320       4330       4340       4350       4360       4370       4380       4390       4400
CCGATGTCAAATGGGAAGACCAGGCAGAGATATCAGGAAGCAGTCCAATCCTGTCAATAACAATATCAGAAGATGGTAGCATGTCGATAAAAAATGAAGA
    D  V  K  W  E  D  Q  A  E  I  S  G  S  S  P  I  L  S  I  T  I  S  E  D  G  S  M  S  I  K  N  E  E 4410       4420       4430       4440       4450       4460       4470       4480       4490       4500
GGAAGAACAAACACTGACCATACTCATTAGAACAGGATTGCTGGTGATCTCAGGACTTTTTCCTGTATCAATACCAATCACGGCAGCAGCATGGTACCTG
  E  E  Q  T  L  T  I  L  I  R  T  G  L  L  V  I  S  G  L  F  P  V  S  I  P  I  T  A  A  A  W  Y  L

> NS3
             4510       4520       4530       4540       4550       4560       4570       4580       4590       4600
TGGGAAGTGAAGAAACAACGGGCCGGAGTATTGTGGGATGTTCCTTCACCCCCACCCATGGGAAAGGCTGAACTGGAAGATGGAGCCTATAGAATTAAGC
  W  E  V  K  K  Q  R  A  G  V  L  W  D  V  P  S  P  P  P  M  G  K  A  E  L  E  D  G  A  Y  R  I  K  Q 4610       4620       4630       4640       4650       4660       4670       4680       4690       4700
AAAAAGGGATTCTTGGATATTCCCAGATCGGAGCCGGAGTTTACAAAGAAGGAACATTCCATACAATGTGGCATGTCACACGTGGCGCTGTTCTAATGCA
     K  G  I  L  G  Y  S  Q  I  G  A  G  V  Y  K  E  G  T  F  H  T  M  W  H  V  T  R  G  A  V  L  M  H 4710       4720       4730       4740       4750       4760       4770       4780       4790       4800
TAAAGGAAAGAGGATTGAACCATCATGGGCGGACGTCAAGAAAGACCTAATATCATATGGAGGAGGCTGGAAGTTAGAAGGAGAATGGAAGGAAGGAGAA
     K  G  K  R  I  E  P  S  W  A  D  V  K  K  D  L  I  S  Y  G  G  G  W  K  L  E  G  E  W  K  E  G  E 4810       4820       4830       4840       4850       4860       4870       4880       4890       4900
GAAGTCCAGGTATTGGCACTGGAGCCTGGAAAAAATCCAAGAGCCGTCCAAACGAAACCTGGTCTTTTCAAAACCAACGCCGGAACAATAGGTGCTGTAT
  E  V  Q  V  L  A  L  E  P  G  K  N  P  R  A  V  Q  T  K  P  G  L  F  K  T  N  A  G  T  I  G  A  V  S 4910       4920       4930       4940       4950       4960       4970       4980       4990       5000
CTCTGGACTTTTCTCCTGGAACGTCAGGATCTCCAATTATCGACAAAAAAGGAAAAGTTGTGGGTCTTTATGGTAATGGTGTTGTTACAAGGAGTGGAGC
  L  D  F  S  P  G  T  S  G  S  P  I  I  D  K  K  G  K  V  V  G  L  Y  G  N  G  V  V  T  R  S  G  A 5010       5020       5030       5040       5050       5060       5070       5080       5090       5100
ATATGTGAGTGCTATAGCCCAGACTGAAAAAAGCATTGAAGACAACCCCAGAGATCGAAGATGACATTTTCCGAAAGAGAAGACTGACCATCATGGACCTC
  Y  V  S  A  I  A  Q  T  E  K  S  I  E  D  N  P  E  I  E  D  D  I  F  R  K  R  R  L  T  I  M  D  L 5110       5120       5130       5140       5150       5160       5170       5180       5190       5200
CACCCAGGAGCGGGAAAGACGAAGAGATACCTTCCGGCCATAGTCAGAGAAGCTATAAAACGGGGTTTGAGAACATTAATCTTGGCCCCCACTAGAGTTG
  H  P  G  A  G  K  T  K  R  Y  L  P  A  I  V  R  E  A  I  K  R  G  L  R  T  L  I  L  A  P  T  R  V  V
```

-continued

```
      5210       5220       5230       5240       5250       5260       5270       5280       5290       5300
TGGCAGCTGAAATGGAGGAAGCCCTTAGAGGACTTCCAATAAGATACCAGACCCCAGCCATCAGAGCTGTGCACACCGGGCGGGAGATTGTGGACCTAAT
  A  A  E  M  E  E  A  L  R  G  L  P  I  R  Y  Q  T  P  A  I  R  A  V  H  T  G  R  E  I  V  D  L  M
                                                                     |
                                D2 PDK-53 NS3-250-Val attenuation locus (D2 16681: Glu, nt-5270-A)

5310       5320       5330       5340       5350       5360       5370       5380       5390       5400
GTGTCATGCCACATTTACCATGAGGCTGCTATCACCAGTTAGAGTGCCAAACTACAACCTGATTATCATGGACGAAGCCCATTTCACAGATCCAGCAAGT
 C  H  A  T  F  T  M  R  L  L  S  P  V  R  V  P  N  Y  N  L  I  I  M  D  E  A  H  F  T  D  P  A  S
                                                                                          |
                              Additional nt-5391 C-to-T silent mutation in master and pre-master seeds 5410       5420       5430       5440       5450       5460       5470       5480       5490       5500
ATAGCAGCTAGAGGATACATCTCAACTCGAGTGGAGATGGGTGAGGCAGCTGGGATTTTTATGACAGCCACTCCCCCGGGAAGCAGAGACCCATTTCCTC
I  A  A  R  G  Y  I  S  T  R  V  E  M  G  E  A  A  G  I  F  M  T  A  T  P  P  G  S  R  D  P  F  P  Q 5510       5520       5530       5540       5550       5560       5570       5580       5590       5600
AGAGCAATGCACCAATCATAGATGAAGAAAGAGAAATCCCTGAACGCTCGTGGAATTCCGGACATGAATGGGTCACGGATTTTAAAGGGAAGACTGTTTG
  S  N  A  P  I  I  D  E  E  R  E  I  P  E  R  S  W  N  S  G  H  E  W  V  T  D  F  K  G  K  T  V  W
                                              |
                                      D2 PDK-53 specific silent mutation nt-5547-C (D2 16681: T)

5610       5620       5630       5640       5650       5660       5670       5680       5690       5700
GTTCGTTCCAAGTATAAAAGCAGGAAATGATATAGCAGCTTGCCTGAGGAAAAATGGAAAGAAAGTGATACAACTCAGTAGGAAGACCTTTGATTCTGAG
 F  V  P  S  I  K  A  G  N  D  I  A  A  C  L  R  K  N  G  K  K  V  I  Q  L  S  R  K  T  F  D  S  E 5710       5720       5730       5740       5750       5760       5770       5780       5790       5800
TATGTCAAGACTAGAACCAATGATTGGGACTTCGTGGTTACAACTGACATTTCAGAAATGGGTGCCAATTTCAAGGCTGAGAGGGTTATAGACCCCAGAC
Y  V  K  T  R  T  N  D  W  D  F  V  V  T  T  D  I  S  E  M  G  A  N  F  K  A  E  R  V  I  D  P  R  R 5810       5820       5830       5840       5850       5860       5870       5880       5890       5900
GCTGCATGAAACCAGTCATACTAACAGATGGTGAAGAGCGGGTGATTCTGGCAGGACCTATGCCAGTGACCCACTCTAGTGCAGCACAAAGAAGAGGGAG
  C  M  K  P  V  I  L  T  D  G  E  E  R  V  I  L  A  G  P  M  P  V  T  H  S  S  A  A  Q  R  R  G  R 5910       5920       5930       5940       5950       5960       5970       5980       5990       6000
AATAGGAAGAAATCCAAAAAATGAGAATGACCAGTACATATACATGGGGGAACCTCTGGAAAATGATGAAGACTGTGCACACTGGAAAGAAGCTAAAATG
 I  G  R  N  P  K  N  E  N  D  Q  Y  I  Y  M  G  E  P  L  E  N  D  E  D  C  A  H  W  K  E  A  K  M 6010       6020       6030       6040       6050       6060       6070       6080       6090       6100
CTCCTAGATAACATCAACACGCCAGAAGGAATCATTCCTAGCATGTTCGAACCAGAGCGTGAAAAGGTGGATGCCATTGATGGCGAATACCGCTTGAGAG
L  L  D  N  I  N  T  P  E  G  I  I  P  S  M  F  E  P  E  R  E  K  V  D  A  I  D  G  E  Y  R  L  R  G 6110       6120       6130       6140       6150       6160       6170       6180       6190       6200
GAGAAGCAAGGAAAACCTTTGTAGACTTAATGAGAAGAGGAGACCTACCAGTCTGGTTGGCCTACAGAGTGGCAGCTGAAGGCATCAACTACGCAGACAG
  E  A  R  K  T  F  V  D  L  M  R  R  G  D  L  P  V  W  L  A  Y  R  V  A  A  E  G  I  N  Y  A  D  R 6210       6220       6230       6240       6250       6260       6270       6280       6290       6300
AAGGTGGTGTTTTGATGGAGTCAAGAACAACCAAATCCTAGAAGAAAACGTGGAAGTTGAAATCTGGACAAAAGAAGGGGAAAGGAAGAAATTGAAACCC
 R  W  C  F  D  G  V  K  N  N  Q  I  L  E  E  N  V  E  V  E  I  W  T  K  E  G  E  R  K  K  L  K  P

> NS4A
      6310       6320       6330       6340       6350       6360       6370       6380       6390       6400
AGATGGTTGGATGCTAGGATCTATTCTGACCCACTGGCGCTAAAAGAATTTAAGGAATTTGCAGCCGGAAGAAAGTCTCTGACCCTGAACCTAATCACAG
R  W  L  D  A  R  I  Y  S  D  P  L  A  L  K  E  F  K  E  F  A  A  G  R  K  S  L  T  L  N  L  I  T  E 6410       6420       6430       6440       6450       6460       6470       6480       6490       6500
AAATGGGTAGGCTCCCAACCTTCATGACTCAGAAGGTAAGAGACGCACTGGACAACTTAGCAGTGCTGCACACGGCTGAGGCAGGTGGAAGGGCGTACAA
  M  G  R  L  P  T  F  M  T  Q  K  V  R  D  A  L  D  N  L  A  V  L  H  T  A  E  A  G  G  R  A  Y  N
                                    |
               Additional NS4A-21 Ala-to-Val (nt-6437 C-to-T) mutation in master and pre-master seeds 6510       6520       6530       6540       6550       6560       6570       6580       6590       6600
CCATGCTCTCAGTGAACTGCCGGAGACCCTGGAGACATTGCTTTTACTGACACTTCTGGCTACAGTCACGGGAGGGATCTTTTTATTCTTGATGAGCGCA
 H  A  L  S  E  L  P  E  T  L  E  T  L  L  L  L  T  L  L  A  T  V  T  G  G  I  F  L  F  L  M  S  A
                                                                                                 |
                                          D2 PDK-53 specific NS4A-75-Ala (wt D2 16681: Gly, nt-6599-G)

6610       6620       6630       6640       6650       6660       6670       6680       6690       6700
AGGGGCATAGGGAAGATGACCCTGGGAATGTGCTGCATAATCACGGCTAGCATCCTCCTATGGTACGCACAAATACAGCCACACTGGATAGCAGCTTCAA
R  G  I  G  K  M  T  L  G  M  C  C  I  I  T  A  S  I  L  L  W  Y  A  Q  I  Q  P  H  W  I  A  A  S  I 6710       6720       6730       6740       6750       6760       6770       6780       6790       6800
TAATACTGGAGTTTTTCTCATAGTTTTGCTTATTCCAGAACCTGAAAAACAGAGAACACCCCAAGACAACCAACTGACCTACGTTGTCATAGCCATCCT
  I  L  E  F  F  L  I  V  L  L  I  P  E  P  E  K  Q  R  T  P  Q  D  N  Q  L  T  Y  V  V  I  A  I  L

> NS4B
      6810       6820       6830       6840       6850       6860       6870       6880       6890       6900
CACAGTGGTGGCCGCAACCATGGCAAACGAGATGGGTTTCCTAGAAAAAACGAAGAAAGATCTCGGATTGGGAAGCATTGCAACCCAGCAACCCGAGAGC
 T  V  V  A  A  T  M  A  N  E  M  G  F  L  E  K  T  K  K  D  L  G  L  G  S  I  A  T  Q  Q  P  E  S
```

```
                                                      -continued
      6910      6920      6930      6940      6950      6960      6970      6980      6990      7000
AACATCCTGGACATAGATCTACGTCCTGCATCAGCATGGACGCTGTATGCCGTGGCCACAACATTTGTTACACCAATGTTGAGACATAGCATTGAAAATT
  N  I  L  D  I  D  L  R  P  A  S  A  W  T  L  Y  A  V  A  T  T  F  V  T  P  M  L  R  H  S  I  E  N  S 7010      7020      7030      7040      7050      7060      7070      7080      7090      7100
CCTCAGTGAATGTGTCCCTAACAGCCATAGCCAACCAAGCCACAGTGTTAATGGGTCTCGGGAAGGATGGCCATTGTCAAAGATGGACATCGGAGTTCC
  S  V  N  V  S  L  T  A  I  A  N  Q  A  T  V  L  M  G  L  G  K  G  W  P  L  S  K  M  D  I  G  V  P
                              |
                Additional nt-7026 T-to-C/T mix silent mutation in master and pre-master seeds 7110      7120      7130      7140      7150      7160      7170      7180      7190      7200
CCTTCTCGCCATTGGATGCTACTCACAAGTCAACCCCATAACTCTCACAGCAGCTCTTTTCTTATTGGTAGCACATTATGCCATCATAGGGCCAGGACTC
  L  L  A  I  G  C  Y  S  Q  V  N  P  I  T  L  T  A  A  L  F  L  L  V  A  H  Y  A  I  I  G  P  G  L 7210      7220      7230      7240      7250      7260      7270      7280      7290      7300
CAAGCAAAAGCAACCAGAGAAGCTCAGAAAAGAGCAGCGGCGGGCATCATGAAAAACCCAACTGTCGATGGAATAACAGTGATTGACCTAGATCCAATAC
  Q  A  K  A  T  R  E  A  Q  K  R  A  A  A  G  I  M  K  N  P  T  V  D  G  I  T  V  I  D  L  D  P  I  P 7310      7320      7330      7340      7350      7360      7370      7380      7390      7400
CTTATGATCCAAAGTTTGAAAAGCAGTTGGGACAAGTAATGCTCCTAGTCCTCTGCGTGACTCAAGTATTGATGATGAGGACTACATGGGCTCTGTGTGA
  Y  D  P  K  F  E  K  Q  L  G  Q  V  M  L  L  V  L  C  V  T  Q  V  L  M  M  R  T  T  W  A  L  C  E 7410      7420      7430      7440      7450      7460      7470      7480      7490      7500
GGCTTTAACCTTAGCTACCGGGCCCATCTCCACATTGTGGGAAGGAAATCCAGGGAGGTTTTGGAACACTACCATTGCGGTGTCAATGGCTAACATTTTT
  A  L  T  L  A  T  G  P  I  S  T  L  W  E  G  N  P  G  R  F  W  N  T  T  I  A  V  S  M  A  N  I  F
                                                                                            > NS5
      7510      7520      7530      7540      7550      7560      7570      7580      7590      7600
AGAGGGAGTTACTTGGCCGGAGCTGGACTTCTCTTTTCTATTATGAAGAACACAACCAACACAAGAAGGGGAACTGGCAACATAGGAGAGACGCTTGGAG
  R  G  S  Y  L  A  G  A  G  L  L  F  S  I  M  K  N  T  T  N  T  R  R  G  T  G  N  I  G  E  T  L  G  E 7610      7620      7630      7640      7650      7660      7670      7680      7690      7700
AGAAATGGAAAAGCCGATTGAACGCATTGGGAAAAAGTGAATTCCAGATCTACAAGAAAAGTGGAATCCAGGAAGTGGATAGAACCTTAGCAAAAGAAGG
  K  W  K  S  R  L  N  A  L  G  K  S  E  F  Q  I  Y  K  K  S  G  I  Q  E  V  D  R  T  L  A  K  E  G 7710      7720      7730      7740      7750      7760      7770      7780      7790      7800
CATTAAAAGAGGAGAAACGGACCATCACGCTGTGTCGCGAGGCTCAGCAAAACTGAGATGGTTCGTTGAGAGAAACATGGTCACACCAGAAGGGAAAGTA
  I  K  R  G  E  T  D  H  H  A  V  S  R  G  S  A  K  L  R  W  F  V  E  R  N  M  V  T  P  E  G  K  V 7810      7820      7830      7840      7850      7860      7870      7880      7890      7900
GTGGACCTCGGTTGTGGCAGAGGAGGCTGGTCATACTATTGTGGAGGACTAAAGAATGTAAGAGAAGTCAAAGGCCTAACAAAAGGAGGACCAGGACACG
  V  D  L  G  C  G  R  G  G  W  S  Y  Y  C  G  G  L  K  N  V  R  E  V  K  G  L  T  K  G  G  P  H  E 7910      7920      7930      7940      7950      7960      7970      7980      7990      8000
AAGAACCCATCCCCATGTCAACATATGGGTGGAATCTAGTGCGTCTTCAAAGTGGAGTTGACGTTTTCTTCATCCCGCCAGAAAAGTGTGACACATTATT
  E  P  I  P  M  S  T  Y  G  W  N  L  V  R  L  Q  S  G  V  D  V  F  F  I  P  P  E  K  C  D  T  L  L 8010      8020      8030      8040      8050      8060      8070      8080      8090      8100
GTGTGACATAGGGGAGTCATCACCAAATCCCACAGTGGAAGCAGGACGAACACTCAGAGTCCTTAACTTAGTAGAAAATTGGTTGAACAACAACACTCAA
  C  D  I  G  E  S  S  P  N  P  T  V  E  A  G  R  T  L  R  V  L  N  L  V  E  N  W  L  N  N  N  T  Q 8110      8120      8130      8140      8150      8160      8170      8180      8190      8200
TTTTGCATAAAGGTTCTCAACCCATATATGCCCTCAGTCATAGAAAAAATGGAAGCACTACAAAGGAAATATGGAGGAGCCTTAGTGAGGAATCCACTCT
  F  C  I  K  V  L  N  P  Y  M  P  S  V  I  E  K  M  E  A  L  Q  R  K  Y  G  G  A  L  V  R  N  P  L  S 8210      8220      8230      8240      8250      8260      8270      8280      8290      8300
CACGAAACTCCACACATGAGATGTACTGGGTATCCAATGCTTCCGGGAACATAGTGTCATCAGTGAACATGATTTCAAGGATGTTGATCAACAGATTTAC
  R  N  S  T  H  E  M  Y  W  V  S  N  A  S  G  N  I  V  S  S  V  N  M  I  S  R  M  L  I  N  R  F  T 8310      8320      8330      8340      8350      8360      8370      8380      8390      8400
AATGAGATACAAGAAAGCCACTTACGAGCCGGATGTTGACCTCGGAAGCGGAACCCGTAACATCGGGATTGAAGTGAGATACCAAACCTAGATATAATT
  M  R  Y  K  K  A  T  Y  E  P  D  V  D  L  G  S  G  T  R  N  I  G  I  E  S  E  I  P  N  L  D  I  I 8410      8420      8430      8440      8450      8460      8470      8480      8490      8500
GGGAAAAGAATAGAAAAATAAAGCAAGAGCATGAAACATCATGGCACTATGACCAAGACCACCCATACAAAACGTGGGCATACCATGGTAGCTATGAAA
  G  K  R  I  E  K  I  K  Q  E  H  E  T  S  W  H  Y  D  Q  D  H  P  Y  K  T  W  A  Y  H  G  S  Y  E  T 8510      8520      8530      8540      8550      8560      8570      8580      8590      8600
CAAAACAGACTGGATCAGCATCATCCATGGTCAACGGAGTGGTCAGGCTGCTGACAAAACCTTGGGACGTCGTCCCCATGGTGACACAGATGGCAATGAC
  K  Q  T  G  S  A  S  S  M  V  N  G  V  V  R  L  L  T  K  P  W  D  V  V  P  M  V  T  Q  M  A  M  T 8610      8620      8630      8640      8650      8660      8670      8680      8690      8700
AGACACGACTCCATTTGGACAACAGCGCGTTTTTAAAGAAAAGTGGACACGAGAACCCAAGAACCGAAAGAAGGCACGAAGAAACTAATGAAAATAACA
  D  T  T  P  F  G  Q  Q  R  V  F  K  E  K  V  D  T  R  T  Q  E  P  K  E  G  T  K  K  L  M  K  I  T 8710      8720      8730      8740      8750      8760      8770      8780      8790      8800
GCAGAGTGGCTTTGGAAAGAATTAGGGAAGAAAAAGACACCCAGGATGTGCACCAGAGAAGAATTCACAAGAAAGGTGAGAAGCAATGCAGCCTGGGGG
  A  E  W  L  W  K  E  L  G  K  K  K  T  P  R  M  C  T  R  E  E  F  T  R  K  V  R  S  N  A  A  L  G  A
```

```
      8810      8820      8830      8840      8850      8860      8870      8880      8890      8900
CCATATTCACTGATGAGAACAAGTGGAAGTCGGCACGTGAGGCTGTTGAAGATAGTAGGTTTTGGGAGCTGGTTGACAAGGAAAGGAATCTCCATCTTGA
  I  F  T  D  E  N  K  W  K  S  A  R  E  A  V  E  D  S  R  F  W  E  L  V  D  K  E  R  N  L  H  L  E 8910      8920      8930      8940      8950      8960      8970      8980      8990      9000
AGGAAAGTGTGAAACATGTGTGTACAACATGATGGGAAAAGAGAGAAGAAGCTAGGGGAATTCGGCAAGGCAAAAGGCAGCAGAGCCATATGGTACATG
  G  K  C  E  T  C  V  Y  N  M  M  G  K  R  E  K  K  L  G  E  F  G  K  A  K  G  S  R  A  I  W  Y  M 9010      9020      9030      9040      9050      9060      9070      9080      9090      9100
TGGCTTGGAGCACGCTTCTTAGAGTTTGAAGCCCTAGGATTCTTAAATGAAGATCACTGGTTCTCCAGAGAGAACTCCCTGAGTGGAGTGGAAGGAGAAG
  W  L  G  A  R  F  L  E  F  E  A  L  G  F  L  N  E  D  H  W  F  S  R  E  N  S  L  S  G  V  E  G  E  G 9110      9120      9130      9140      9150      9160      9170      9180      9190      9200
GGCTGCACAAGCTAGGTTACATTCTAAGAGACGTGAGCAAGAAAGAGGGAGGAGCAATGTATGCCGATGACACCGCAGGATGGGATACAAGAATCACACT
  L  H  K  L  G  Y  I  L  R  D  V  S  K  K  E  G  G  A  M  Y  A  D  D  T  A  G  W  D  T  R  I  T  L 9210      9220      9230      9240      9250      9260      9270      9280      9290      9300
AGAAGACCTAAAAAATGAAGAAATGGTAACAAACCACATGGAAGGAGAACACAAGAAACTAGCCGAGGCCATTTTCAAACTAACGTACCAAAACAAGGTG
  E  D  L  K  N  E  E  M  V  T  N  H  M  E  G  E  H  K  K  L  A  E  A  I  F  K  L  T  Y  Q  N  K  V 9310      9320      9330      9340      9350      9360      9370      9380      9390      9400
GTGCGTGTGCAAAGACCAACACCAAGAGGCACAGTAATGGACATCATATCGAGAAGAGACCAAAGAGGTAGTGGACAAGTTGGCACCTATGGACTAATA
  V  R  V  Q  R  P  T  P  R  G  T  V  M  D  I  I  S  R  R  D  Q  R  G  S  G  Q  V  G  T  Y  G  L  N  T 9410      9420      9430      9440      9450      9460      9470      9480      9490      9500
CTTTCACCAATATGGAAGCCCAACTAATCAGACAGATGGAGGGAGAAGGAGTCTTTAAAAGCATTCAGCACCTAACAATCACAGAAGAAATCGCTGTGCA
  F  T  N  M  E  A  Q  L  I  R  Q  M  E  G  E  G  V  F  K  S  I  Q  H  L  T  I  T  E  E  I  A  V  Q 9510      9520      9530      9540      9550      9560      9570      9580      9590      9600
AAACTGGTTAGCAAGAGTGGGGCGCGAAAGGTTATCAAGAATGGCCATCAGTGGAGATGATTGTGTTGTGAAACCTTTAGATGACAGGTTCGCAAGCGCT
  N  W  L  A  R  V  G  R  E  R  L  S  R  M  A  I  S  G  D  D  C  V  V  K  P  L  D  D  R  F  A  S  A 9610      9620      9630      9640      9650      9660      9670      9680      9690      9700
TTAACAGCTCTAAATGACATGGGAAAGATTAGGAAAGACATACAACAATGGGAACCTTCAAGAGGATGGAATGATTGGACACAAGTGCCCTTCTGTTCAC
  L  T  A  L  N  D  M  G  K  I  R  K  D  I  Q  Q  W  E  P  S  R  G  W  N  D  W  T  Q  V  P  F  C  S  H 9710      9720      9730      9740      9750      9760      9770      9780      9790      9800
ACCATTTCCATGAGTTAATCATGAAAGACGGTCGCGTACTCGTTGTTCCCTGTAGAAACCAAGATGAACTGATTGGCAGAGCCCGAATCTCCCAAGGAGC
  H  F  H  E  L  I  M  K  D  G  R  V  L  V  V  P  C  R  N  Q  D  E  L  I  G  R  A  R  I  S  Q  G  A
                                                   |
                               Additional nt-9750 A-to-C silent mutation in master and pre-master seeds 9810      9820      9830      9840      9850      9860      9870      9880      9890      9900
AGGGTGGTCTTTGCGGGAGACGGCCTGTTTGGGGAAGTCTTACGCCCAAATGTGGAGCTTGATGTACTTCCACAGACGCGACCTCAGGCTGGCGGCAAAT
  G  W  S  L  R  E  T  A  C  L  G  K  S  Y  A  Q  M  W  S  L  M  Y  F  H  R  R  D  L  R  L  A  A  N 9910      9920      9930      9940      9950      9960      9970      9980      9990     10000
GCTATTTGCTCGGCAGTACCATCACATTGGGTTCCAACAAGTCGAACAACCTGGTCCATACATGCTAAACATGAATGGATGACAACGGAAGACATGCTGA
  A  I  C  S  A  V  P  S  H  W  V  P  T  S  R  T  T  W  S  I  H  A  K  H  E  W  M  T  T  E  D  M  L  T 10010     10020     10030     10040     10050     10060     10070     10080     10090     10100
CAGTCTGGAACAGGGTGTGGATTCAAGAAAACCCATGGATGGAAGACAAAACTCCAGTGGAATCATGGGAGGAAATCCCATACTTGGGGAAAAGAGAAGA
  V  W  N  R  V  W  I  Q  E  N  P  W  M  E  D  K  T  P  V  E  S  W  E  E  I  P  Y  L  G  K  R  E  D 10110     10120     10130     10140     10150     10160     10170     10180     10190     10200
CCAATGGTGCGGCTCATTGATTGGGTTAACAAGCAGGGCCACCTGGGCAAAGAACATCCAAGCAGCAATAAATCAAGTTAGATCCCTTATAGGCAATGAA
  Q  W  C  G  S  L  I  G  L  T  S  R  A  T  W  A  K  N  I  Q  A  A  I  N  Q  V  R  S  L  I  G  N  E > 3'-Noncoding Region
     10210     10220     10230     10240     10250     10260     10270     10280     10290     10300
GAATACACAGATTACATGCCATCCATGAAAAGATTCAGAAGAAGAGGAAGAAGCAGGAGTTCTGTGGTAGAAAGCAAAACTAACATGAAACAAGGCTA
  E  Y  T  D  Y  M  P  S  M  K  R  F  R  R  E  E  E  E  A  G  V  L  W  *

10310     10320     10330     10340     10350     10360     10370     10380     10390     10400
GAAGTCAGGTCGGATTAAGCCATAGTACGGAAAAAACTATGCTACCTGTGAGCCCCGTCCAAGGACGTTAAAAGAAGTCAGGCCATCATAAATGCCATAG 10410     10420     10430     10440     10450     10460     10470     10480     10490     10500
CTTGAGTAAACTATGCAGCCTGTAGCTCCACCTGAGAAGGTGTAAAAAATCCGGGAGGCCACAAACCATGGAAGCTGTACGCATGGCGTAGTGGACTAGC 10510     10520     10530     10540     10550     10560     10570     10580     10590     10600
GGTTAGAGGAGACCCCTCCCTTACAAATCGCAGCAACAATGGGGGCCCAAGGCGAGATGAAGCTGTAGTCTCGCTGGAAGGACTAGAGGTTAGAGGAGAC 10610     10620     10630     10640     10650     10660     10670     10680     10690     10700
CCCCCCGAAACAAAAAACAGCATATTGACGCTGGGAAAGACCAGAGATCCTGCTGTCTCCTCAGCATCATTCCAGGCACAGAACGCCAGAAAATGGATG 10710     10720
GTGCTGTTGAATCAACAGGTTCT
```

SEQUENCE LISTING (34 sequences)

SEQ ID NO: 1 - DNA, 10723 bp, Artificial Sequence
  Dengue virus serotype 1, Pre-Master
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacgcgtgggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggttcctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccctaccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagatcaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccgaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 2 - protein, 3391 aa, Artificial Sequence
  Dengue virus serotype 1, Pre-Master
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTLPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEDQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 3 - DNA, 10723 bp, Artificial Sequence; identical to SEQ ID NO: 1
  Dengue virus serotype 1, MVS

SEQ ID NO: 4 - protein, 3391 aa, Artificial Sequence; identical to SEQ ID NO: 2
  Dengue virus serotype 1, MVS

SEQ ID NO: 5 - DNA, 10723 bp, Artificial Sequence
  Dengue virus serotype 1, WVS
  misc_feature (2384)..(2384): n is either cytosine or guanine
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacgcgtgggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggttcctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagccgncattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccctaccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagatcaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcatagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccgaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 6 - protein, 3391 aa, Artificial Sequence
  Dengue virus serotype 1, WVS
  misc_feature (763)..(763): Xaa is either alanine or glycine
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAAXIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTLPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEDQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLIAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 7 - DNA, 10723 bp, Artificial Sequence
  Dengue virus serotype 1, BVS
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacgcgtgggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggttcctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagccgccattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccctaccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagatcaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcatagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccgaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 8 - protein, 3391 aa, Artificial Sequence
  Dengue virus 1, BVS
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAAAIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTLPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEDQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLIAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 9 - DNA, 10723 bp, Artificial Sequence
  Dengue virus serotype 2, Pre-Master
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggttggcgtgaacatgtgtaccctcatggccatggaccttggtgaattgtgtgaagacacaatcacgtacgagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgatcttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccatttggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccgtattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 10 - protein, 3391 aa, Artificial Sequence
  Dengue virus serotype 2, Pre-Master
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEVGVNMCTLMAMDLGELCEDTITYECPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAVFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 11 - DNA, 10723 bp, Artificial Sequence; identical to SEQ ID NO: 9
  Dengue virus serotype 2, MVS

SEQ ID NO: 12 - protein, 3391 aa, Artificial Sequence; identical to SEQ ID NO: 10
  Dengue virus serotype 2, MVS

SEQ ID NO: 13 - DNA, 10723 bp, Artificial Sequence
  Dengue virus serotype 2, WVS
  misc_feature (6481)..(6481): n is either cytosine or guanine
  misc_feature (7156)..(7156): n is either cytosine or thymine
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggttggcgtgaacatgtgtaccctcatggccatggaccttggtgaattgtgtgaagacacaatcacgtacgagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgatcttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccatttggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgagncaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctnttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccgtattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 14 - protein, 3391 aa, Artificial Sequence
  Dengue virus serotype 2, WVS
  misc_feature (2129)..(2129): Xaa is either alanine or proline
  misc_feature (2354)..(2354): Xaa is either leucine or phenylalanine
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEVGVNMCTLMAMDLGELCEDTITYECPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEXGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAAXFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAVFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 15 - DNA, 10723 bp, Artificial Sequence
  Dengue virus serotype 2, BVS
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggttggcgtgaacatgtgtaccctcatggccatggaccttggtgaattgtgtgaagacacaatcacgtacgagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgatcttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccatttggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgagccaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagcttttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccgtattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 16 - protein, 3391 aa, Artificial Sequence
  Dengue virus serotype 2, BVS
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEVGVNMCTLMAMDLGELCEDTITYECPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEPGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAAFFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAVFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 17 - DNA, 10717 bp, Artificial Sequence
  Dengue virus serotype 3, Pre-Master
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacgcgtgatggagagccgcgcatgattgtggggaagaatgaaagaggaaaatccctacttttcaagacagcctctggaatcaacatgtgcacactcatagctatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagcttcagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttgagtagctttgtgttgaagaaagaagtctccgaaacgcagcatgggacaatactcattaaggttgagtacaaaggggaagatgcaccctgcaagattcctttctccacggaggatggacaaggaaaagctctcaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcggccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcgttgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 18 - protein, 3389 aa, Artificial Sequence
  Dengue virus serotype 3, Pre-Master
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGASAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTEDGQGKALNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 19 - DNA, 10717 bp, Artificial Sequence; identical to SEQ ID NO: 17
  Dengue virus serotype 3, MVS

SEQ ID NO: 20 - protein, 3389 aa, Artificial Sequence; identical to SEQ ID NO: 18
  Dengue virus serotype 3, MVS

SEQ ID NO: 21 - DNA, 10717 bp, Artificial Sequence
  Dengue virus serotype 3, WVS
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacgcgtgatggagagccgcgcatgattgtggggaagaatgaaagaggaaaatccctacttttcaagacagcctctggaatcaacatgtgcacactcatagctatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagcttcagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttgagtagctttgtgttgaagaaagaagtctccgaaacgcagcatgggacaatactcattaaggttgagtacaaaggggaagatgcaccctgcaagattcctttctccacggaggatggacaaggaaaagctctcaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcggccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagaaacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcgttgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 22 - protein, 3389 aa, Artificial Sequence
  Dengue virus serotype 3, WVS
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGASAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTEDGQGKALNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 23 - DNA, 10717 bp, Artificial Sequence; identical to SEQ ID NO: 21
  Dengue virus serotype 3, BVS

SEQ ID NO: 24 - protein, 3389 aa, Artificial Sequence; identical to SEQ ID NO: 22
  Dengue virus serotype 3, BVS

SEQ ID NO: 25 - DNA, 10723 bp, Artificial Sequence
  Dengue virus serotype 4, Pre-Master
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggacctttaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagctctgcaggcatgatcattatgctgattccaacagtgatggcgttccatttaaccacgcgtgatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacgtccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgtaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccctgtttggaggagtctcatggatgattagaatcctaattgggttcctagtgttgtggattggcacgaactcaaggaacacttcaatggctatgacgtgcatagctgccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacgggtgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagatccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggtaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagccatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccctgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 26 - protein, 3391 aa, Artificial Sequence
  Dengue virus serotype 4, Pre-Master
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRSSAGMIIMLIPTVMAFHLTTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTLFGGVSWMIRILIGFLVLWIGTNSRNTSMAMTCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTGDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKVRDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 27 - DNA, 10723 bp, Artificial Sequence
  Dengue virus serotype 4, MVS
  misc_feature (3773)..(3773): n is either adenine or guanine
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggacctttaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagctctgcaggcatgatcattatgctgattccaacagtgatggcgttccatttaaccacgcgtgatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacgtccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgtaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccctgtttggaggagtctcatggatgattagaatcctaattgggttcctagtgttgtggattggcacgaactcaaggaacacttcaatggctatgacgtgcatagctgccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacgggtgacataggtatgggcgtgacttatcttgccctactagcagccttcaaagtcagaccaacttttgcagctggactactcttgagaaagctgacctccanggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagatccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggtaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagccatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccctgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 28 - protein, 3391 aa, Artificial Sequence
  Dengue virus serotype 4, MVS
  misc_feature (1226)..(1226): Xaa is either lysine or arginine
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRSSAGMIIMLIPTVMAFHLTTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTLFGGVSWMIRILIGFLVLWIGTNSRNTSMAMTCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTGDIGMGVTYLALLAAFKVRPTFAAGLLLRKLTSXELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKVRDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 29 - DNA, 10723 bp, Artificial Sequence
  Dengue virus serotype 4, WVS
  misc_feature (3773)..(3773): n is either adenine or guanine
  misc_feature (7538)..(7538): n is either cytosine or thymine
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggacctttaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagctctgcaggcatgatcattatgctgattccaacagtgatggcgttccatttaaccacgcgtgatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacgtccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgtaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccctgtttggaggagtctcatggatgattagaatcctaattgggttcctagtgttgtggattggcacgaactcaaggaacacttcaatggctatgacgtgcatagctgccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacgggtgacataggtatgggcgtgacttatcttgccctactagcagccttcaaagtcagaccaacttttgcagctggactactcttgagaaagctgacctccanggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagatccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggtaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagccatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttntattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccctgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 30 - protein, 3391 aa, Artificial Sequence
  Dengue virus serotype 4, WVS
  misc_feature (1226)..(1226): Xaa is either lysine or arginine
  misc_feature (2481)..(2481): Xaa is either serine or phenylalanine
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRSSAGMIIMLIPTVMAFHLTTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTLFGGVSWMIRILIGFLVLWIGTNSRNTSMAMTCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTGDIGMGVTYLALLAAFKVRPTFAAGLLLRKLTSXELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKVRDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFXIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 31 - DNA, 10723 bp, Artificial Sequence; identical to SEQ ID NO: 29
  Dengue virus serotype 4, BVS
  misc_feature (3773)..(3773): n is either adenine or guanine
  misc_feature (7538)..(7538): n is either cytosine or thymine

SEQ ID NO: 32 - protein, 3391 aa, Artificial Sequence; identical to SEQ ID NO: 30
  Dengue virus serotype 4, BVS
  misc_feature (1226)..(1226): Xaa is either lysine or arginine
  misc_feature (2481)..(2481): Xaa is either serine or phenylalanine

SEQ ID NO: 33 - protein, 3464 aa, Artificial Sequence
  Dengue virus serotype 1, WVS
  misc_feature (763)..(763): Xaa is either alanine or glycine
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAAXIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTLPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEDQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLIAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLWKAKLTNKARSQVGLSHSTEKTMLPVSPVQGRKKSGHHKCHSLSKLCSLLHLRRCKKSGRPQTMEAVRMAWTSG

SEQ ID NO: 34 - protein, 3464 aa, Artificial Sequence
  Dengue virus sertype 1, BVS
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAAAIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTLPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEDQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLIAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLWKAKLTNKARSQVGLSHSTEKTMLPVSPVQGRKKSGHHKCHSLSKLCSLLHLRRCKKSGRPQTMEAVRMAWTSG

What is claimed is:

1. A dengue-2 virus polypeptide comprising SEQ ID NO: 10.

2. A kit comprising the polypeptide according to claim 1 and a container.

3. A pharmaceutical composition comprising the polypeptide according to claim 1, and a pharmaceutically acceptable carrier or excipient.

4. The pharmaceutical composition of claim 3, further comprising a pharmaceutically acceptable adjuvant.

5. The pharmaceutical composition of claim 3, wherein the composition comprises a tetravalent dengue virus composition capable of inducing an immune response in a subject against all four dengue virus serotypes.

6. A method for inducing an immune response in a subject comprising administering a pharmaceutically acceptable amount of a composition of claim 3 to the subject, wherein the composition induces an immune response to dengue virus in the subject.

7. The pharmaceutical composition of claim 3, further comprising one or more of the following polypeptides:

a polypeptide comprising SEQ ID NO: 2, 4, 6, 8, 12, 14, 16, 18, 20, 22, 24, 26, 28, 30, and 32; wherein SEQ ID NOs: 2, 4, 6, and 8 represent dengue-1/dengue-2 chimeric polypeptides, wherein SEQ ID NOs: 12, 14, and 16 represent dengue-2 virus polypeptides, wherein SEQ ID NOs: 18, 20, 22 and 24 represent dengue-3/dengue-2 chimeric polypeptides, and wherein SEQ ID NOs: 26, 28, 30 and 32 represent dengue-4/dengue-2 chimeric polypeptides.

8. The pharmaceutical composition of claim 7, further comprising a pharmaceutically acceptable adjuvant.

9. The kit according to claim 2, wherein the polypeptide is part of a pharmaceutical composition.

10. The kit according to claim 9, wherein the kit comprises pharmaceutical compositions of all four dengue virus serotypes.

11. A method for inducing an immune response in a subject comprising administering a pharmaceutically acceptable amount of a composition of claim 3 to the subject, wherein the composition induces an immune response in the subject against at least one dengue virus serotype.

* * * * *